United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 6

SEQ ID NO: 5237 - DNA, 10691 bp, Homo sapiens
gcggcccggtgcgggtgtcggggagaccgggctctctgcccggcgcggcgcggcgcggctcggcccacgagcgaccaccgacatggagtgggctcgggcggccaagtagccgcttctccggagcccggtgccagtgccgcccgcagcccgccttccacccccggccgcgccgccggtcaggccctagggtgaagccgggaggaaaatgaagagttttcaccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaaactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgccaggtttcccttatccatcccctcatcatcactccggtctgatctcctctccgatcaactttgaacacatctatcacatgactgttaattctgctgaaaaatttctctctcctgattccataaaccctgaatattccccgtctctgcgctctgtccctggtacaccaagctttatgactctgaggaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctcacagataaagtattttattactatctgaagttttcttttgttttcatgcaggacattttaaaaacgtatatggcagcagaaacctgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatgtatttatacacatccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaatctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtt

SEQ ID NO: 5238 - DNA, 10658 bp, Homo sapiens
gcggcccggtgcgggtgtcggggagaccgggctctctgcccggcgcggcgcggcgcggctcggcccacgagcgaccaccgacatggagtgggctcgggcggccaagtagccgcttctccggagcccggtgccagtgccgcccgcagcccgccttccacccccggccgcgccgccggtcaggccctagggtgaagccgggaggaaaatgaagagttttcaccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaagattccttttcttcttcctcatcttcactgattgattttttggatgacactgatcccgttgagaacacatatgtatggaacccgagcgtcaagtttcacatccagtcacggtccacatctccttccacatctagtgaagctgagccagttaagactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctcacagataaagtattttattactatctgaagttttcttttgttttcatgcaggacattttaaaaacgtatatggcagcagaaacctgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatgtatttatacacatccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaatctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtt

SEQ ID NO: 5239 - DNA, 10421 bp, Homo sapiens
gcggcccggtgcgggtgtcggggagaccgggctctctgcccggcgcggcgcggcgcggctcggcccacgagcgaccaccgacatggagtgggctcgggcggccaagtagccgcttctccggagcccggtgccagtgccgcccgcagcccgccttccacccccggccgcgccgccggtcaggccctagggtgaagccgggaggaaaatgaagagttttcaccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaacgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctcacagataaagtattttattactatctgaagttttcttttgttttcatgcaggacattttaaaaacgtatatggcagcagaaacctgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatgtatttatacacatccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaatctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtt

SEQ ID NO: 5240 - DNA, 5732 bp, Homo sapiens
atttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaacgctctccatcctgtactccagctagcaaaggcagacgtactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgag

SEQ ID NO: 5241 - DNA, 10610 bp, Homo sapiens
gcggcccggtgcgggtgtcggggagaccgggctctctgcccggcgcggcgcggcgcggctcggcccacgagcgaccaccgacatggagtgggctcgggcggccaagtagccgcttctccggagcccggtgccagtgccgcccgcagcccgccttccacccccggccgcgccgccggtcaggccctagggtgaagccgggaggaaaatgaagagttttcaccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaaactgatcccgttgagaacacatatgtatggaacccgagcgtcaagtttcacatccagtcacggtccacatctccttccacatctagtgaagctgagccagttaagactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctcacagataaagtattttattactatctgaagttttcttttgttttcatgcaggacattttaaaaacgtatatggcagcagaaacctgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatgtatttatacacatccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaatctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtt

SEQ ID NO: 5242 - DNA, 9320 bp, Homo sapiens
atgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaaactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctcacagataaagtattttattactatctgaagttttcttttgttttcatgcaggacattttaaaaacgtatatggcagcagaaacctgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatgtatttatacacatccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaatctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtta

SEQ ID NO: 5243 - DNA, 10855 bp, Homo sapiens
tccgcaagcctccgcctctgtgcggcgggactggaggagcctcgctgagcccagggcgcgagcgcgagaggagagggaaggcgggggagggctggaagggagaggaagggagtggttgggagccgggctgccgcagcctctagtctcctcagccgcggaagcgacccctcctcctgcgccgggccgcctccctcctcgctgtggaaagatgcccttagcccaggggtgtgaagaagggggagaagtagctgccagagccgcccgcgccgccgccgcagctgctgctgcttgtgtcctttgaattcagagaagcacccccccgcctggggcgtcgggagcctccggcgcggcggcccggtgcgggtgtcggggagaccgggctctctgcccggcgcggcgcggcgcggctcggcccacgagcgaccaccgacatggagtgggctcgggcggccaagtagccgcttctccggagcccggtgccagtgccgcccgcagcccgccttccacccccggccgcgccgccggtcaggccctagggtgaagccgggaggaaaatgaagagttttcaccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaaactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctcacagataaagtattttattactatctgaagttttcttttgttttcatgcaggacattttaaaaacgtatatggcagcagaaacctgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatgtatttatacacatccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaatctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtta

SEQ ID NO: 5244 - DNA, 2501 bp, Homo sapiens
cgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaagtaagtgccggggctacaggaaggtgcctctgagacagggtgacccccagctccctcccctcctgtcccgtgggtgacatgtccttcacttacgtgtgcccattgcattctcaagtggctgcagtgtctcagaccctgctgggtaatgcctaataggcacaaatgcagttgttaagaaaatagtcccagagtccttctagagtgtacaggccatctgggagacagacaaatatgattacaaattgtgatgataaaggctctgaaggaagtaaacagcatacattaatagagaataacaaggggtagctgttagggatgaatccctacttggcagaataattaggaaaatcactccctagaggtggagtcatgtttgagtaatgtttggttaactgaaagaaggctagtatggctacatggtagtggtgaggaagtaacaaaaattagagcggggtagcaggtaagggtcagaccagcagggacttgaagaccaaggtaagacattttttactttattcaaaaggaaaaggaagacttttaagtagggaagaattttctttcaatttacattcttaaaacaatcctgcgggctgccaagtggagaatggactagaggcaggaagagtggaagccagcatccagataggagactcctagagtggtcccaatggaaaccaatgagggcttgggatgcagcaggggcagaaggagagaagatggtagattctccagatatattttcagagttaaaagcagtaagacttgatgatgaattagtcatggaaaagtaagggagagagttaaagatgactcccagacttcctgctagggccttagtatgataccatttactcccatttaccaccgtttaagaaggggctgaggcaggacattccacgcatgtccaaaggtcccgaggtagcaaaaaaaaaaaaaaaa

SEQ ID NO: 5245 - DNA, 2183 bp, Homo sapiens
ggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaagattccttttcttcttcctcatcttcactgattgattttttggatgacactgatcccgttgagaacacatatgtatggaacccgagcgtcaagtttcacatccagtcacggtccacatctccttccacatctagtgaagctgagccagttaagactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcag

SEQ ID NO: 5246 - DNA, 3786 bp, Homo sapiens
agaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaaactgatcccgttgagaacacatatgtatggaacccgagcgtcaagtttcacatccagtcacggtccacatctccttccacatctagtgaagctgagccagttaagactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaa

SEQ ID NO: 5247 - DNA, 7355 bp, Homo sapiens
gcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaagggtatagagcaccaagactcacagcattctttcttggcatttttgaatacgcctaccgatgctctggatcaatttgaaactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgccaggtttcccttatccatcccctcatcatcactccggtctgatctcctctccgatcaactttgaacacatctatcacatgactgttaattctgctgaaaaatttctctctcctgattccataaaccctgaatattccccgtctctgcgctctgtccctggtacaccaagctttatgactctgaggaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttccgtagcagcttagattaacgttgatttcattccatgcacttagagttgctttcagtaacattttacccctactcccaaaggtagcttaaatagacagattacacaaatgtaagtgataagaataagattagacagattttgctttcacagtagagtctcattatagtcctaaaatagctcatgggcttctccgcatccagaagggagaattggtccctggagtggctcactaagctcttaatcagcaaacgcagtgagtatcaacctgattgttgccaggaaatccttatgaattaaaacaatgcatattttactacagtacagagtttaaatgaatacataaatgtagaagtactgaatgtatatatttaaaaggagcctcttgtattcaacaaaagatggatgcatatataagagagatgatttaatttaaagaaatatgttgtttcttgtctgtaatgtaatgtaaagggtggaaaggcctcaagctcacatttgtagagagagagcgagagaaatcagagttccctttattgccctgtcctcaaactggtcataggctctagtcacctggggagctgtagaaaacacttgcagagccaggttttgctggtttggggcatgccctgggcaccagagctttaacatttgaagccacttcagcagcagcagcaaaaggcgaactcatctctacccaagatgtttcttttcctagtggtggaatttgaacacttctcactttttattgtattttatcttccgcagataaatgtagaaatacacgattctgtcacctctgatcccttccatctgaaaggttacaaggagtgttgtagcttctgaaggtgcagaaaacaatttctaaaaatgcttttattcctgggctaatcctgtccctccctaagtcacagcgaggtgtctgtcccagggctggagatgcttcccaaggaggagtctgttttgttgagagtgggcgtgggcttcttcacataagcctggggaaggaagaaaaaacggctttcattaccaaataatgtaaaacctcaaaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagagaaagagataaaaataaaagtatctcatgaaggaaagagattttgcctctcttttacttttcacctaagtttctctgagaaatagagacaggattctctctttaaaattcagtgaaaatgaagaaagttttcctgcagttgctaacctgagttgcagtgtttaaggccatcatttcactgctgctgtctgtgactccacgtctgtgtcactgaggtgacctgcgtgtcactgaggtggccaccatgctggcctgcggcatgtgcagggagctgaggctgtttccaggtgatgctgctgtgtggagaaggttctgagatgcagtgagggaagaaaggatcctgctggggattccattgtaagcacctataatcgggaattttcatgtaacagctttgacatttaaacattctgagtttggtgccagctcagatttgattatattttattttggatgggtgtaattcacagcacagttctaatctcccaaatctttctgctttttagaatgaagtataaaaatacttttctcacctgaataccaagggttggccctttagttggatcattgtcatatgacttggtagatccttgtcctcagcacctcacgtgagagaagggagtcagccagccggccccctgcttggtgctcgtgaccagctcgcaccccttctgtccacccttctctcctctcctccccactctccccaccctcctcactctccccaccctcctcactctccccaccctcccctcctctcctcctcactcttcccaccctccccatccccaccctccccatcctcctcttccctttccccttgccttctcctctctcccttctcttctcaggcagggaggaggccatcccaagccgagattaacaggacttgacataagccattagtttgtagctttgacaagtaattatgaatttttgttgcttataggtgcttattttgcaaaggatgcttttaagatcaaaataataaccctacctaaagtctagctccactgctatgggtcatactcttcagcctcccaacagggcagagagagagagctactgaggcttgtctaggttgccaggctaactgggcgacttgtccatattcaccccatggattgcaccatggcactctttgatttttccactgcaatggcaagtaatctcatcagtcataatagagcagtcccgaatgcgtgcagattctaaaagcagggctttaggagagaaacactgccagggggaatagttttggggagggttttcccaaaataacggtcatcctactgggtttatcccacccttaaatatgaagcctgttacctccagaagcttctgagaagaatgatgtgaaaagacagggagtgggttctaggcaaagaaaacataatgaccattcagaggagtcagtagcacagctcacagataaagtattttattactatctgaagttttcttttgttttcatgcaggacattttaaaaacgtatatggcagcagaaacctgtttctcaatagaaaaaatacattcagaggcatttctgggatagtctatctgtgttagtatttggtgctatctatgtccagccaagttatctaccctcaaattctgactaatcatgtttgtgctttgggtatttaaaattacatacatatatattctttttgccaaaaacaaaagtcttgcttcttgtcaaatgattgctaaagtagatcttacattttttgttattatgtatgtatttatacacatccccaacacacttagtgatttctgttatttcctagggagcacagctttaaggctatgagatacaactaaaaggagcccatctatttggttttccagccaattattgtactcacatttcaggggagaatctgaaattcctgtcatgtttacagcaacaatctatcattcctggctagctctcagcctctctctccttccataggttagaattatgtcattttgttacttagtggccacgtctatttctgagaaagactggttacatttatgtggcatctcaggtatcattaaggaaaagccagagcaggggtgagcagaggtcaaaaccacagacgcagcagggccatttgccgcctttggccgggatcacaaccactgcagtctcccagcaggtaggccttgccaagcctaaggctccccatccaatctagacagaggggcgctcagagcagactttgccgtagcccatgtctggtgagcacaacagggaatgaattgggcactccactcccccgtctctctggcccagccctgaactagatgagctgcatttcatggagcccattttaaaatctctttccttatgactttgttactcaagtccagagttctctgtgcacttctgctagataaggagtgtaagccctgccccccagcactggcagcacgctgggccctccccacacaggacaccgtgcagttccgggggaagctgactcaaatcaaccttgaaatctcatgaaaacaaaatgacttgtctttttatttgatagtgtaatatcattcattttataaattttttagggtttttctcgtaatattgtacagttttgcatggcctggtgtgatcattttttggttagaatataatgctgacaaatgtggatggaggggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaataaaacagagaactgtt

SEQ ID NO: 5248 - DNA, 5158 bp, Homo sapiens
ggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaacagatatgccctggaaaatgcgtcgttttgcgaaactggatatgtcagctagactggagttgcagtcggctctggatgcagaaataagagccaaacaggccatccaagaagagttgaataaagttaaagcatctaatatcataacagaatgtaaactaaaagattcagagaagaagaacttggaactactctcagaaatcgaacagctgataaaggacactgaagagcttagatctgaaaaggctagcaaaggcagacgtactgtagactccactccactttcagttcacacaccaaccttaaggaaaaaaggatgtcctggttcaactggctttccacctaagcgcaagactcaccagttttttgtaaaatcttttactactcctaccaagtgtcatcagtgtacctccttgatggtgggtttaataagacagggctgttcatgtgaagtgtgtggattctcatgccatataacttgtgtaaacaaagctccaaccacttgtccagttcctcctgaacagacaaaaggtcccctgggtatagatcctcagaaaggaataggaacagcatatgaaggtcatgtcaggattcctaagccagctggagtgaagaaagggtggcagagagcactggctatagtgtgtgacttcaaactctttctgtacgatattgctgaaggaaaagcatctcagcccagtgttgtcattagtcaagtgattgacatgagggatgaagaattttctgtgagttcagtcttggcttctgatgttatccatgcaagtcggaaagatataccctgtatatttagggtcacagcttcccagctctcagcatctaataacaaatgttcaatcctgatgctagcagacactgagaatgagaagaataagtgggtgggagtgctgagtgaattgcacaagattttgaagaaaaacaaattcagagaccgctcagtctatgttcccaaagaggcttatgacagcactctacccctcattaaaacaacccaggcagccgcaatcatagatcatgaaagaattgctttgggaaacgaagaagggttatttgttgtacatgtcaccaaagatgaaattattagagttggtgacaataagaagattcatcagattgaactcattccaaatgatcagcttgttgctgtgatctcaggacgaaatcgtcatgtacgactttttcctatgtcagcattggatgggcgagagaccgatttttacaagctgtcagaaactaaagggtgtcaaaccgtaacttctggaaaggtgcgccatggagctctcacatgcctgtgtgtggctatgaaaaggcaggtcctctgttatgaactatttcagagcaagacccgtcacagaaaatttaaagaaattcaagtcccatataatgtccagtggatggcaatcttcagtgaacaactctgtgtgggattccagtcaggatttctaagataccccttgaatggagaaggaaatccatacagtatgctccattcaaatgaccatacactatcatttattgcacatcaaccaatggatgctatctgcgcagttgagatctccagtaaagaatatctgctgtgttttaacagcattgggatatacactgactgccagggccgaagatctagacaacaggaattgatgtggccagcaaatccttcctcttgttgttacaatgcaccatatctctcggtgtacagtgaaaatgcagttgatatctttgatgtgaactccatggaatggattcagactcttcctctcaaaaaggttcgacccttaaacaatgaaggatcattaaatcttttagggttggagaccattagattaatatatttcaaaaataagatggcagaaggggacgaactggtagtacctgaaacatcagataatagtcggaaacaaatggttagaaacattaacaataagcggcgttattccttcagagtcccagaagaggaaaggatgcagcagaggagggaaatgctacgagatccagaaatgagaaataaattaatttctaatccaactaattttaatcacatagcacacatgggtcctggagatggaatacagatcctgaaagatctgcccatgaaccctcggcctcaggaaagtcggacagtattcagtggctcagtcagtattccatctatcaccaaatcccgccctgagccaggccgctccatgagtgctagcagtggcttgtcagcaaggtcatccgcacagaatggcagcgcattaaagagggaattctctggaggaagctacagtgccaagcggcagcccatgccctccccgtcagagggctctttgtcctctggaggcatggaccaaggaagtgatgccccagcgagggactttgacggagaggactctgactctccgaggcattccacagcttccaacagttccaacctaagcagccccccaagcccagcttcaccccgaaaaaccaagagcctctccctggagagcactgaccgcgggagctgggacccgtgagctgcctcagcactgggacctctcgctctcc

SEQ ID NO: 5249 - DNA, 6758 bp, Homo sapiens
gggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtgcagtcctccgtggccgtgggcacacctgactacatctcgccggagatcctgcaggcgatggaggacggcatgggcaaatacgggcctgagtgtgactggtggtctctgggtgtctgcatgtatgagatgctctatggagaaacgccgttttatgcggagtcactcgtggagacctatgggaagatcatgaaccatgaagagcgattccagttcccatcccatgtcacggatgtatctgaagaagcgaaggacctcatccagagactgatctgcagtagagaacgccggctggggcagaatggaatagaggatttcaaaaagcatgcgttttttgaaggtctaaattgggaaaatatacgaaacctagaagcaccttatattcctgatgtgagcagtccctctgacacatccaacttcgacgtggatgacgacgtgctgagaaacacggaaatattacctcctggttctcacacaggcttttctggattacatttgccattcattggttttacattcacaacggaaagctgtttttctgatcgaggctctctgaagagcataatgcagtccaacacattaaccaaagatgaggatgtgcagcgggacctggagcacagcctgcagatggaagcttacgagaggaggattcggaggctggaacaggagaagctggagctgagcaggaagctgcaagagtccacccagaccgtgcagtccctccacggctcatctcgggccctcagcaattcaaaccgagataaagaaatcaaaaagctaaatgaagaaatcgaacgcttgaagaataaaatagcagattcaaacaggctcgagcgacagcttgaggacacagtggcgcttcgccaagagcgtgaggactccacgcagcggctgcgggggctggagaagcagcaccgcgtggtccggcaggagaaggaggagctgcacaagcaactggttgaagcctcagagcggttgaaatcccaggccaaggaactcaaagatgcccatcagcagcgaaagctggccctgcaggagttctcggagctgaacgagcgcatggcagagctccgtgcccagaagcagaaggtgtcccggcagctgcgagacaaggaggaggagatggaggtggccacgcagaaggtggacgccatgcggcaggaaatgcggagagctgagaagctcaggaaagagctggaagctcagcttgatgatgctgttgctgaggcctccaaggagcgcaagcttcgtgagcacagcgagaacttctgcaagcaaatggaaagcgagctggaggccctcaaggtgaagcaaggaggccggggagcgggtgccaccttagagcaccagcaagagatttccaaaatcaaatccgagctggagaagaaagtcttattttatgaagaggaattggtcagacgtgaggcctcccatgtgctagaagtgaaaaatgtgaagaaggaggtgcatgattcagaaagccaccagctggccctgcagaaagaaatcttgatgttaaaagataagttagaaaagtcaaagcgagaacggcataacgagatggaggaggcagtaggtacaataaaagataaatacgaacgagaaagagcgatgctgtttgatgaaaacaagaagctaactgctgaaaatgaaaagctctgttcctttgtggataaactcacagctcaaaatagacagctggaggatgagctgcaggatctggcagccaagaaggagtcagtggcccactgggaagctcagattgcggaaatcattcagtgggtcagtgacgagaaagatgcccggggttaccttcaagctcttgcttccaagatgaccgaagagctcgaggctttgaggagttctagtctggggtcaagaacactggacccgctgtggaaggtgcgccgcagccagaagctggacatgtccgcgcggctggagctgcagtcggccctggaggcggagatccgggccaagcagcttgtccaggaggagctcaggaaggtcaaggacgccaacctcaccttggaaagcaaactaaaggattccgaagccaaaaacagagaattattagaagaaatggaaattttgaagaaaaagatggaagaaaaattcagagcagatactgggctcaaacttccagattttcaggattccatttttgagtatttcaacactgctcctcttgcacatgacctgacatttagaaccagctcagctagtgagcaagaaacacaagctccgaagccagaagcgtccccgtcgatgtctgtggctgcatcagagcagcaggaggacatggctcggcccccgcagaggccatccgctgtgccgttgcccaccacgcaggccctggctctggctggaccgaagccaaaagctcaccagttcagcatcaagtccttctccagccctactcagtgcagccactgcacctccctgatggttgggctgatccggcagggctacgcctgcgaggtgtgttcctttgcttgccacgtgtcctgcaaagacggtgccccccaggtgtgcccaatacctcccgagcagtccaagaggcctctgggcgtggacgtgcagcgaggcatcggaacagcctacaaaggccatgtcaaggtcccaaagcccacgggggtgaagaagggatggcagcgcgcatatgcagtcgtctgtgactgcaagctcttcctgtatgatctgcctgaaggaaaatccacccagcctggtgtcattgcgagccaagtcttggatctcagagatgacgagttttccgtgagctcagtcctggcctcagatgtcattcatgctacacgccgagatattccatgtatattcagggtgacggcctctctcttaggtgcaccttctaagaccagctcgctgctcattctgacagaaaatgagaatgaaaagaggaagtgggttgggattctagaaggactccagtccatccttcataaaaaccggctgaggaatcaggtcgtgcatgttcccttggaagcctacgacagctcgctgcctctcatcaaggccatcctgacagctgccatcgtggatgcagacaggattgcagtcggcctagaagaagggctctatgtcatagaggtcacccgagatgtgatcgtccgtgccgctgactgtaagaaggtacaccagatcgagcttgctcccagggagaagatcgtaatcctcctctgtggccggaaccaccatgtgcacctctatccgtggtcgtcccttgatggagcggaaggcagctttgacatcaagcttccggaaaccaaaggctgccagctcatggccacggccacactcaagaggaactctggcacctgcctgtttgtggccgtgaaacggctgatcctttgctatgagatccagagaacgaagccattccacagaaagttcaatgagattgtggctcccggcagcgtgcagtgcctggcggtgctcagggacaggctctgtgtgggctacccttctgggttctgcctgctgagcatccagggggacgggcagcctctaaacctggtaaatcccaatgacccctcgcttgcgttcctctcacaacagtcttttgatgccctttgtgctgtggagctcgaaagcgaggagtacctgctttgcttcagccacatgggactgtacgtggacccgcaaggccggagggcacgcgcgcaggagctcatgtggcctgcggctcctgtcgcctgtagttgcagccccacccacgtcacggtgtacagcgagtatggcgtggacgtctttgatgtgcgcaccatggagtgggtgcagaccatcggcctgcggaggataaggcccctgaactctgaaggcaccctcaacctcctcaactgcgagcctccacgcttgatctacttcaagagcaagttctcgggagcggttctcaacgtgccggacacctccgacaacagcaagaagcagatgctgcgcaccaggagcaaaaggcggttcgtcttcaaggtcccagaggaagagagactgcagcagaggcgagagatgcttagagacccagaattgagatccaaaatgatatccaacccaaccaacttcaaccacgtggcccacatgggcccaggcgacggcatgcaggtgctcatggacctgcctctgagtgctgtgcccccctcccaggaggaaaggccgggccccgctcccaccaacctggctcgccagcctccatccaggaacaagccctacatctcgtggccctcatcaggtggatcggagcctagcgtgactgtgcctctgagaagtatgtctgatccagaccaggactttgacaaagagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggaccagtgacaccctgcgtccctgtgtgcattaagttcattctgggtcgcagccatgaagtgtcaccagtatctactactgtgaagtcagctgtgctgttttccattcgcttccacggcttctgcctcctgccataaaaccagcgagtgtcgtggtgcaggcaggccctgtggcctgctgggctgagggaagtcagagccccagggcgccacgaagcagccactgggataccccaccccgccccgccctgcccgcccccccccccaccagtcctgcccccgcatggagcccccgtgattagtagcccgtatgatcacgtagacccacccaacacactcctgcacactggccccggcccacggcacagcaatcccctgcgcgtggatttcacctcaccctttgtaccagatgttgagtgaccagctctgtggccctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagttc

SEQ ID NO: 5250 - DNA, 1592 bp, Homo sapiens
ggaaggtgcgccgcagccagaagctggacatgtccgcgcggctggagctgcagtcggccctggaggcggagatccgggccaagcagcttgtccaggaggagctcaggaaggtcaaggacgccaacctcaccttggaaagcaaactaaaggattccgaagccaaaaacagagaattattagaagaaatggaaattttgaagaaaaagatggaagaaaaattcagagcagatactgggctcaaacttccagattttcaggattccatttttgagtatttcaacactgctcctcttgcacatgacctgacatttagaaccagctcagctagtgagcaagaaacacaagctccgaagccagaagcgtccccgtcgatgtctgtggctgcatcagagcagcaggagccaaaagctcaccagttcagcatcaagtccttctccagccctactcagtgcagccactgcacctccctgatggttgggctgatccggcagggctacgcctgcgaggtgtgttcctttgcttgccacgtgtcctgcaaagacggtgccccccaggtgtgcccaatacctcccgagcagtccaagaggcctctgggcgtggacgtgcagcgaggcatcggaacagcctacaaaggccatgtcaaggtcccaaagcccacgggggtgaagaagggatggcagcgcgcatatgcagtcgtctgtgactgcaagctcttcctgtatgatctgcctgaaggaaaatccacccagcctggtgtcattgcgagccaagtcttggatctcagagatgacgagttttccgtgagctcagtcctggcctcagatgtcattcatgctacacgccgagatattccatgtatattcagggtgacggcctctctcttaggtgcaccttctaagaccagctcgctgctcattctgacagaaaatgagaatgaaaagaggaagtgggttgggattctagaaggactccagtccatccttcataaaaaccggctgaggaatcaggtcgtgcatgttcccttggaagcctacgacagctcgctgcctctcatcaaggccatcctgacagctgccatcgtggatgcagacaggattgcagtcggcctagaagaagggctctatgtcatagaggtcacccgagatgtgatcgtccgtgccgctgactgtaagaaggtacaccagatcgagcttgctcccagggagaagatcgtaatcctcctctgtggccggaaccaccatgtgcacctctatccgtggtcgtcccttgatggagcggaaggcagctttgacatcaagcttccggaaaccaaaggctgccagctcatggccacggccacactcaagaggaactctggcacctgcctgtttgtggccgtgaaacggctgatcctttgctatgagatccagagaacgaagccattccacagaaagttcaatgagattgtggctcccggcagcgtgcagtgcctggcggtgctcagggacaggctctgtgtgggctacccttctgggttctgcctgctgagcatccagggggacgggcagcctctaaacctggtaaatcccaatgacccctcgcttgcgttcctc

SEQ ID NO: 5251 - DNA, 5742 bp, Homo sapiens
atggagcggcggctgcgcgcgctggagcagctggcgcggggcgaggccggcggctgcccggggctcgacggcctcctagatctgctgctggcgctgcaccacgagctcagcagcggccccctacggcgggagcgcagcgtggcgcagttcctgagctgggccagccccttcgtatcaaaggtgaaagaactgcgtctgcagagagatgactttgagatcttgaaggtgatcggccgaggagcctttggggaggtcaccgtggtgaggcagagggacactgggcagatttttgccatgaaaatgctgcacaagtgggagatgctgaagagggctgagacagcctgtttccgggaggagcgggatgtgctcgtgaaaggggacagccgttgggtgaccactctgcactatgccttccaagacgaggagtacctgtaccttgtgatggactactatgctggtggggacctcctgacgctgctgagccgcttcgaggaccgtctcccgcccgagctggcccagttctacctggctgagatggtgctggccatccactcgctgcaccagctgggttatgtccacagggatgtcaagccagacaacgtcctgctggatgtgaacgggcacattcgcctggctgacttcggctcctgcctgcgtctcaacaccaacggcatggtggattcatcagtggcagtagggacgccggactatatctcccctgagatcctgcaggccatggaggagggcaagggccactacggcccacagtgtgactggtggtcgcttggagtctgcgcctatgagctgctctttggggagacgcccttctatgctgagtccttggtggaaacctacggcaagatcatgaaccacgaggaccacctgcagttccccccggacgtgcctgacgtgccagccagcgcccaagacctgatccgccagctgctgtgtcgccaggaagagcggctaggccgtggtgggctggatgacttccggaaccatcctttcttcgaaggcgtggactgggagcggctggcgagcagcacggccccctatattcctgagctgcgggggcccatggacacctccaactttgatgtggatgacgacaccctcaaccatccagggaccctgccaccgccctcccacggggccttctccggccatcacctgccattcgtgggcttcacctacacctcaggcagtcacagtcctgagagcagctctgaggcttgggctgccctggagcggaagctccagtgtctggagcaggagaaggtggagctgagcaggaagcaccaagaggccctgcacgcccccacagaccatcgggagctggagcagctacggaaggaagtgcagactctgcgggacaggctgccagagatgctgagggacaaggcctcattgtcccagacggatgggcccccagctggtagcccaggtcaggacagtgacctacggcaggagcttgaccgacttcaccgggagctggccgagggtcgggcagggctgcaggctcaggagcaggagctctgcagggcccaggggcagcaggaggagctgcttcagaggctacaggaggcccaggagagagaggcggccacagctagccagacccgggccctgagctcccagctggaggaagcccgggctgcccagagggagctggaggcccaggtgtcctccctgagccggcaggtgacgcagctgcagggacagtgggagcaacgccttgaggagtcgtcccaggccaagaccatccacacagcctctgagaccaacgggatgggaccccctgagggtgggcctcaggaggcccaactgaggaaggaggtggccgccctgcgagagcagctggagcaggcccacagccacaggccgagtggtaaggaggaggctctgtgccagctgcaggaggaaaaccggaggctgagccgggagcaggagcggctagaagcagagctggcccaggagcaggagagcaagcagcggctggagggtgagcggcgggagacggagagcaactgggaggcccagctcgccgacatcctcagctgggtgaatgatgagaaggtctcaagaggctacctgcaggccctggccaccaagatggcagaggagctggagtccttgaggaacgtaggcacccagacgctccctgcccggccactggaccaccagtggaaggcgcggcgactgcagaagatggaggcctcggccaggctggagctgcagtcagcgctggaggccgagatccgcgccaagcagggcctgcaggagcggctgacacaggtgcaggaggcccagctgcaggctgagcgccgtctgcaggaggccgagaagcagagccaggccctgcaacaggagctcgccatgctgcgggaggagctgcgggcccgagggccagtggacaccaagccctcaaactccctgattcccttcctgtccttccggagctcagagaaggattctgccaaggaccctggcatctcaggagaggccacaaggcatggaggagagccagatctgaggccggagggccgacgcagcctgcgcatgggggctgtgttccccagagcacccactgccaacacagcctctacagaaggtcttcctgctaagcccggctcacacacgctgcgcccccggagcttcccatccccgaccaagtgtctccgctgcacctcgctgatgctgggcctgggccgccagggcctgggttgtgatgcctgcggctacttttgtcacacaacctgtgccccacaggccccaccctgccccgtgccccctgacctcctccgcacagccctgggagtacaccccgaaacaggcacaggcactgcctatgagggctttctgtcggtgccgcggccctcaggtgtccggcggggctggcagcgcgtgtttgctgccctgagtgactcacgcctgctgctgtttgacgcccctgacctgaggctcagcccgcccagtggggccctcctgcaggtcctagatctgagggacccccagttctcggctacccctgtcctggcctctgatgttatccatgcccaatccagggacctgccacgcatctttagggtgacaacctcccagctggcagtgccgcccaccacgtgcactgtgctgctgctggcagagagcgagggggagcgggaacgctggctgcaggtgctgggtgagctgcagcggctgctgctggacgcgcggccaagaccccggcccgtgtacacactcaaggaggcttacgacaacgggctgccgctgctgcctcacacgctctgcgctgccatcctcgaccaggatcgacttgcgcttggcaccgaggaggggctctttgtcatccatctgcgcagcaacgacatcttccaggtgggggagtgccggcgcgtgcagcagctgaccttgagccccagtgcaggcctgctggtcgtgctgtgtggccgcggccccagcgtgcgtctctttgccctggcggagctggagaacatagaggtagcaggtgccaagatccccgagtctcgaggctgccaggtgctggcagctggaagcatcctgcaggcccgcaccccggtgctctgtgtagccgtcaagcgccaggtgctctgctaccagctgggcccgggccctgggccctggcagcgccgcatccgtgagctgcaggcacctgccactgtgcagagcctggggctgctgggcgaccggctatgtgtgggcgccgccggtggctttgcactctacccgctgctcaacgaggctgcgccgttggcgctgggggccggtttggtgcctgaggagctgccaccatcccgcgggggcctgggtgaggcactgggtgccgtggagcttagcctcagcgagttcctgctactcttcaccactgctggcatctacgtggatggcgcaggccgcaagtctcgtggccacgagctgttgtggccagcagcgcccatgggctgggggtatgcggccccctacctgacagtgttcagcgagaactccatcgatgtgtttgacgtgaggagggcagaatgggtgcagaccgtgccgctcaagaaggtgcggcccctcaatccagagggctccctgttcctctacggcaccgagaaggtccgcctgacctacctcaggaaccagctggcagagaaggacgagttcgacatcccggacctcaccgacaacagccggcgccagctgttccgcaccaagagcaagcgccgcttctttttccgcgtgtcggaggagcagcagaagcagcagcgcagggagatgctgaaggacccttttgtgcgctccaagctcatctcgccgcctaccaacttcaaccacctagtacacgtgggccctgccaacgggcggcccggcgccagggacaagtccccggctcccgaagagaagggccgagttgcccgcggctccggcccacagcggccccacagcttctccgaggcgttgcggcgcccagcctccatgggcagcgaaggcctcggtggagacgcagaccccatgaagaggaaaccctggacatccctgtccagcgagtctgtgtcctgcccccagggatcgctgagccctgcaacctccctaatgcaggtctcagaacggccccgaagcctccccctatcccctgaattggagagctctccttgatgccctctgttagggcccaccccaatcccagggcagaaggacatgagggagcaaagagcttgaggaatgccatactccggctggtccgggacatggaaattcggactcagggaggacccgggctgggcaatgactgggagacttgcctgggttcccaggacttgggggtcctgactcccagccctcatcctgccttacccctctgttcccagccccagcctttctaagccattgggaatagaatggccccttttgttctggtgtccaggggtgattgtgccaaagctcttatttccagtgccaagcccccagaggcttgtaagagttgggatgagggatggagagggactgggtctctgggaacaggttggaggtcttatctgtggactgtctgactcccagctgaggccaagatggggcatgtccccgtctctgcttagcgtctgggtgagaaaaacaggctgtgatccagaagaagggaagatagagaaggagggaaaggatgtaggcgaaggaggtgagagacaggataggaggaaggaagtggaggaggaggtgataggaattggaaggaggtagaagccgtgcagaggaagaggggagagggacgaaggaggagcgatgaagaagaggagggagacaaaaagagggatggaggagagagggagtctggagaacaaagggtcctttctctggggaggggtgcagtgggcggggctgacactgtcagccaatcctcccatcggggaagagaatcctggacagggacaggatggggagggtatttataagggctttttggtgggagatgggtacccagtgggggccactggagggtctccgggcacactctggcccttcccagaaagggggtcgtttttctcgaatcttcaaccagttgtgtattggaaactagggcgcattttactattgatcacagtcattatattgttattatattactatttttattaaacctccccccactgaagtgtggggggcaaaataagtatttatctcctcaaatgccacattcccaggagggacagaccctgatgctctgtgaggcgcaagaaaccaataaag

SEQ ID NO: 5252 - DNA, 2181 bp, Homo sapiens
gatccagcccgcggagcccgcggccagggcggcgcagaccggcccagcgactctcccgggctgccagccgggacgcgcggccgccgccgctgcagacgacgagtccgccctcgtcccgcgcccccggggctcgcggagccaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagctccgggagcacccatcgctcaccccgcagcttcctggccaagaagctgcagctggtgcggagggtgggggcgcccccccggaggatggcatctccccctgcaccctccccggctccaccggccatctcccccatcatcaagaacgccatctccctgccccagctcaaccaggccgcctacgacagcctcgtggttggcaagctcagcttcgacagcagccccaccagctccacggacggccactccagctacggcctggactctgggttctgcaccatctcccgcctgccccgctcggaaaagccgcatgaccgagaccgggatggttccttcccctctgagcccgggcttcgccgctctgactctctcttgtccttccgcctggacctcgaccttgggccctcactcctcagcgagctgctaggggtcatgagcctcccagaagcccctgcagctgagactccagcccccgctgcaaaccccccagcccctactgcaaaccccacgggtcctgctgcaaaccccccagccactactgcaaaccccccagcgcctgctgcaaacccctcagcacctgccgcaacccccacgggtcctgctgcaaatcccccagcccctgccgcaagctccacaccccatggacactgtcccaatggggtaacagctgggttgggcccagtggctgaggtgaagtccagcccagtgggagggggtccccgaggacctgctggccctgccctcggcaggcactggggagcaggctgggatggcggccaccactacccagagatggatgcgcggcaggagcgggtggaggtgctgccccaagcccgggcctcctgggagagcctggacgaagagtggagggcgccccaggcaggcagcaggaccccagtgcccagcacagtgcaagcaaacacctttgaatttgcggatgctgaggaggatgatgaggtcaaggtgtgaggggctggggcacggtcccagggccccacctaggtgcagagccggcccctcacctaacagctggttcctaccagaccggagaggggagaagtcatgttgcccctaaacccctccccacctctgcaggacagacatgggagggaggacagggaaggccaggcttgctctgggacttttatgctcccagaggccctgccaaactgaccacctcccccgactgccactctggacctaatagctgttccttaggccccactccatgccacccccaccagctggaggacccagcctcacagtgtgtcctttgtgccagaccaagcggcccgtggggggtggggggcagggagtgtaccacacagggccattgtctcacctcccaaagggaccgcctgcccccagctcatcccagagcgtccctgctgcaaccctgacagccgtctcccaggccgcttccccaacatccccgccccagcctccctcttaccccagaaaggtcaggtatgacctcccggggaggaatcccacctgcctgtataccccagacttgcctctggggcctgattaaataaggctgttttgataaaa

SEQ ID NO: 5253 - DNA, 588 bp, Homo sapiens
agtattgagatttctatgcttggaggtggcagcaatggttttaaaaaaggaagaaggctgagccgcagacataggtgttcttaaggatcattattgacttttatcagctgaggtcccaggtctgtgtaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggaca

SEQ ID NO: 5254 - DNA, 720 bp, Homo sapiens
gcagaccggcccagcgactctcccgggctgccagccgggacgcgcggccgccgccgctgcagacgacgagtccgccctcgtcccgcgcccccggggctcgcggagccagacggaatgttgctcttgttgccgaggctggagtgccgtgatgtgatcttggctcactgcaacctctgcctccaaggttcaagtgattctcctgccacagcttcctgggtagctgggattacaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagc

SEQ ID NO: 5255 - DNA, 564 bp, Homo sapiens
ttgaatatgctcacgcatggaggaggcagctggaaaaagccacttttgaccacaggatccttattccaggaagctccttgaaggtggatggttcagaggaacctctgctctggctgtttacccagcttcacaaagctttggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccat

SEQ ID NO: 5256 - DNA, 2023 bp, Homo sapiens
attggctccgcgggccggggcggggctgcggggtccgcggtgcactctgtaagttcaccgccggtcgggtccggccgccgcgctgtccagctcctgagaccttgctgtccgccggtctgccgtctgcgcgcctcacgctcctcagccctggaccggggacaagtaaccctcggtgacaagaccaaagtgcactgctgcccacacagttcctacctttctggcttcaattcttcagaagagtttgccgtcctttggggagaacgtgatttttgttatctcagcccactgacttcattgatctctaatcttttttaattccttgggccaactttgttcgtgcccccacactgtagccagaagcccgttggcgagctctggcacctgcaaaccaccccgtggaacgagtgtttcctctggctgagggttggagaggaggtgtggtctcagcaggcggcccgtagcctcacagccaggcctggtggtgaggtcaccatgtccaccaaggtgcccatctatctgaagcgtggcagtcgcaagggcaagaaggagaagcttcgggacctgctgtcctcggacatgatcagcccaccgctgggggacttccgccacaccattcatattggcagtggcggcggcagtgacatgtttggcgacatctccttcctgcagggcaagttccacctcctgccggggaccatggtggaggggcctgaagaagatggcaccttcgacctccccttccagttcacccgcaccgccaccgtgtgtgggcgggagctcccggacggcccatcccctctgctcaagaacgccatctccctcccggttatcggtggaccccaggctctcaccctgcccacagcccaggctccacccaagccccctcgcctgcacctggagacccctcagccttccccacaggagggagggagtgtggacatctggaggattccagagactggctcccccaacagtggactgaccccggagtcaggggccgaggagcccttcctgtccaatgccagctccctgctgtccctgcacgtggacctggggccttccatcctggatgatgtcctgcagatcatggatcaggacctggacagcatgcagatccccacataggacacgaggctgcctaggctggggtcccaggtggggcccagccaggaggtggggtgtggacccggccctggcggcggagtcagggtcccaagatcccacctgtatggtcgctggccagtgattctccttctgagccgtgtttcccctctccctccctctccacgtgggcagggcaggccccatcgctttcctctgataaccacatggacacatcctgaagtcagcccaggcgccctgagcatcttggggcacctggaccccatcacaatactccttcttccttcaggtccctgggtgaaggctttgctgaaaccgaccccccttttcacgtcccttctgcctctgccccgttggatgccctgactgggggcaggggaagagacagggcacagctggccacagggctcagccactgagcaggctgttccgggcctttggctttgcatcctggacggggagtgtcctgtcagggaccagatgtgtcctgcctcatccctagctccaatcccttccccacgtgaccggggattctggttgcaataaaacatgctgctgctggtggcggagctccctgtccctttgccccaggtttcctcccggaggcagacagtctcccagagctgagggcttgcctctggagaccccagccccagagggctttgtggaggacaggccttgccctcaagaacgtcgtacctgacgctgagcctgtcatgagaatgcaacaggagcaaaccaagtgttgctgtgacattgattcagatgtttggcaagaggtggctgagcactggggtgggcttggcactgtgccaagcctggggccaatccctgcccagtcagctggggtctggtgggggacacccaagaataaaagaataaccacaaagtgtgcaaggga

SEQ ID NO: 5257 - DNA, 1279 bp, Homo sapiens
cgagcgacaaattgcatgtttgtcagcatggcccccaggcctggcatggttgacacaggatgaatgcgtgacgggattccaagacctcagggtgcccatgcgtccccacccttcccccagctccttgcaagctgagctggatttccgccacgggagagtcattcctttgtttcctgttaagctccaggtgctctgggagggctcctcagccctggaccggggacaagtaaccctcggtgacaagaccaaagtgcactgctgcccacacagttcctacctttctggcttcaattcttcagaagagtttgccgtcctttggggagaacgtgatttttgttatctcagcccactgacttcattgatctctaatcttttttaattccttgggccaactttgttcgtgcccccacactgtagccagaagcccgttggcgagctctggcacctgcaaaccaccccgtggaacgagtgtttcctctggctgagggttggagaggaggtgtggtctcagcaggcggcccgtagcctcacagccaggcctggtggtgaggtcaccatgtccaccaaggtgcccatctatctgaagcgtggcagtcgcaagggcaagaaggagaagcttcgggacctgctgtcctcggacatgatcagcccaccgctgggggacttccgccacaccattcatattggcagtggcggcggcagtgacatgtttggcgacatctccttcctgcagggcaagttccacctcctgccggggaccatggtggaggggcctgaagaagatggcaccttcgacctccccttccagttcacccgcaccgccaccgtgtgtgggcgggagctcccggacggcccatcccctctgctcaagaacgccatctccctcccggttatcggtggaccccaggctctcaccctgcccacagcccaggctccacccaagccccctcgcctgcacctggagacccctcagccttccccacaggagggagggagtgtggacatctggaggattccagagactggctcccccaacagtggactgaccccggagtcaggggccgaggagcccttcctgtccaatgccagctccctgctgtccctgcacgtggacctggggccttccatcctggatgatgtcctgcagatcatggatcaggacctggacagcatgcagatccccacataggacacgaggctgcctaggctggggtcccaggtggggcccagccaggaggtggggtgtggacccggccctggcggcggagtcagggtccca

SEQ ID NO: 5258 - DNA, 2128 bp, Homo sapiens
aagctccaggtgctctgggaggggtaagatgtccggcctctgtggctcagtacgactgacccgggtgtccggtcctggggtggggtttcctgagcaagggcctcagctggtggggggaggggggcagttggactctgcttctcctgcatcctccttcctccttcctgctcccgcctcccaaccccctcacccccaccctcaccctgcccagaatgaaaactgaggcaaagaactggcaagagccacctttgctcctcagccctggaccggggacaagtaaccctcggtgacaagaccaaagtgcactgctgcccacacagttcctacctttctggcttcaattcttcagaagagtttgccgtcctttggggagaacgtgatttttgttatctcagcccactgacttcattgatctctaatcttttttaattccttgggccaactttgttcgtgcccccacactgtagccagaagcccgttggcgagctctggcacctgcaaaccaccccgtggaacgagtgtttcctctggctgagggttggagaggaggtgtggtctcagcaggcggcccgtagcctcacagccaggcctggtggtgaggtcaccatgtccaccaaggtgcccatctatctgaagcgtggcagtcgcaagggcaagaaggagaagcttcgggacctgctgtcctcggacatgatcagcccaccgctgggggacttccgccacaccattcatattggcagtggcggcggcagtgacatgtttggcgacatctccttcctgcagggcaagttccacctcctgccggggaccatggtggaggggcctgaagaagatggcaccttcgacctccccttccagttcacccgcaccgccaccgtgtgtgggcgggagctcccggacggcccatcccctctgctcaagaacgccatctccctcccggttatcggtggaccccaggctctcaccctgcccacagcccaggctccacccaagccccctcgcctgcacctggagacccctcagccttccccacaggagggagggagtgtggacatctggaggattccagagactggctcccccaacagtggactgaccccggagtcaggggccgaggagcccttcctgtccaatgccagctccctgctgtccctgcacgtggacctggggccttccatcctggatgatgtcctgcagatcatggatcaggacctggacagcatgcagatccccacataggacacgaggctgcctaggctggggtcccaggtggggcccagccaggaggtggggtgtggacccggccctggcggcggagtcagggtcccaagatcccacctgtatggtcgctggccagtgattctccttctgagccgtgtttcccctctccctccctctccacgtgggcagggcaggccccatcgctttcctctgataaccacatggacacatcctgaagtcagcccaggcgccctgagcatcttggggcacctggaccccatcacaatactccttcttccttcaggtccctgggtgaaggctttgctgaaaccgaccccccttttcacgtcccttctgcctctgccccgttggatgccctgactgggggcaggggaagagacagggcacagctggccacagggctcagccactgagcaggctgttccgggcctttggctttgcatcctggacggggagtgtcctgtcagggaccagatgtgtcctgcctcatccctagctccaatcccttccccacgtgaccggggattctggttgcaataaaacatgctgctgctggtggcggagctccctgtccctttgccccaggtttcctcccggaggcagacagtctcccagagctgagggcttgcctctggagaccccagccccagagggctttgtggaggacaggccttgccctcaagaacgtcgtacctgacgctgagcctgtcatgagaatgcaacaggagcaaaccaagtgttgctgtgacattgattcagatgtttggcaagaggtggctgagcactggggtgggcttggcactgtgccaagcctggggccaatccctgcccagtcagctggggtctggtgggggacacccaagaataaaagaataaccacaaagtg

SEQ ID NO: 5259 - DNA, 5700 bp, Homo sapiens
ccggagcccgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaacggtgacccccccccgcgcgcgcgcccggccaccggttggccccgggccagggcacaggtaccgcggctgggagggtcggccccgctgcccgcgccctccgccccgccccagtgagtccccgcgccgccggccccgccccgcgccgccccgccctccgcaggttcagtcctcgcgtccggccgccccgcgctcagtcgcgcgcaccttctctcgcggccgggggaccgcagcgcggggctagcccggagacccggccaccggcctggggcgccttcacgccgtctcggagcggataatgcggtgagcaggcaccacgccggcagactcggctggatctgcgcacagcggcagggattgcgtgcgcccgcgggaggcccggggcagcggctgggatcctcagcggcggccggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaagggaaagactaagtcagaggagtccctctctgaccttacaggttccctcctctccctgcagcttgatcttgggccctcacttttggatgaggtgctgaatgtaatggataaaaataagtaacaagatgccaacttttttcctttggggtaaaaggtacaaaaacaaactaaccacagttgaagagaagggcttccggagctgtatttgcagttttgtgttgggttttctaaaataatattcttacaaagtatttttttacctgttatgccctgtttgcaaaaacaatttagaaaaaaacaacaaagcaaaacctatcttggcaaaaaaaggaagtgagtcagagcccattttcaggaggcattggtgatgttcggctcacatattgtttgcagacacacaagaaatctggcttggccaggattggcactagctatgaagggctgagcgagtcacattaaggaacttcacggaactttatagcactccgacattttctgagcaagaggaagtcaaaatttatttaacacctaagcctttttgtagactcttttctatatattgcttaggctcaccatagcgaattctccagtgttaaaacttttctgttttcacatttgaactttatgggttttggggattttcttgtagttcttatatatccctatatattatatctatattgcaaaattttgactgtcagctacatgttggtaagacacaggcaaagtattactgtaactaagttatttttaaagttaaaatatatttttacgtgcctttggctttttattgcagagtctacattttatagattctacatcagatgttgtcacttatttccattgggattccattgtaagctgtgtatgtgcgtgtttggaaaagtgtattcatacttagtttttttttcttcatctgttatcatacttttaacagcaaccaataacggattgtaaagtgtaaaggcacaggttactcatgatgcttctgcagagactgtgggctacaccacatatgttatttggaaatataggtattttagtacagtacatacttgcattacataggtacttcaagcaacacaataaaaagtaaatgataaagtgaacttgcttgtttatagtaataaacaagaccataagagaataagtatagctagagaaattgcttctctgaaatgtacatgagcccttaaggtaagagatgatttccatctactctcattttgattacttccttatggtttgagaggctagaaactgagcctctctacttttggaaaaatgaacatgtgaggtcagatttttttttttttttttaagtcagcactgatgccaccctctcagtggtcatttctgagcatcttcctgacttgaacaccttctacagcaaactcttgcaagtccagtttcatccctgtaaggcaaatgtcttttcacgcagaaagtgccatatagacgagataaaggcagctaaaacgagggcagtagagagcacttacccgaccccaaggtgccagagatgccctgaggatggtggttaaggaaacaggagcaggaaatgtacacacagattcctgtccctttgccaactactccttccccatcaaagaaaaacacttgcacacagtaactaccagctccttctctcaaacttgtatttctcctggaaatgtatctcagaaatgacctcctctcccaaccacttcaacgattctttctttgggtttggggttcttgcagttctatcatctaaaataacctttggactgcaggtaaaatgcaattaggacaactaaccaagtagacgaaacaagttcccctaggcaggggtgtccaatattttagcttccctggaccgcattggaagaattttcttgggccacatgtaaaacacactaacactaaccatagttgatgagcttaaaaaaataaaaatagaaaattgcaaaaaaaaaaaaaaaaaaaaatctcagactgttttaagaaagtttaaaaatttgtgttggacttcatgcgggccacaggttggacaagcttgccctagggcattgtgtgctttccgtaacttctcagttgtatttcgttatccatgactctccagtgttttttctgttggaccacacccgtcacagttcacagttccaaagagaaatttcccagcctattctaaatcttgttaatgacgaagagtccaatgtatctcattatttgtagccaattttagactcttttcaatacctcccccccattttaattagtattgatcatattcagtctttcattttactcttcatctgtagcgtgacctcaaggtaaagatgaaactatttcatgaaaaggggaggagtatggctgtgcattagctctactccctctctggtaagtactggggagagaacagccctgccagtactgggtttgatagattctaaatattaatcacacatcctgcctacagttagccattttagtttctgggagttctttcatgtacattttcttccattaattgaattaggtataattgagatggcaataaatatgcccgtattagaaagaggaaacaaagctacatgcggcttatgattttgttgagtcacttctcccgaggcagcctttccaatgcctggtcccttcccctgagagcaggtggactgctggtggtggctttctttcctgcagagaggcactttagacccatacctgctgtgagctgaattgatgttctcatcctgtgaaccttctcccactttaacctaatttatctttacttgtttaaagataaggaaacccaagatgtactttatttgcaaactcaaagcaaatggcgagccacctgtgacccagtaaccagaaaagaaaccatgccatttgtataagtagagacacttcttgttgaggtaggcaaggctcttgtgagcgatttttttcccctagtgagacctaacaaaagacaagctatatcatttctgcctgaaattatctgcttgaaaagatcaaaatatcaggatacttagctcttcacaaatatgaagtcattatcacatttcactgagccagaaatcactgttaacagcacacacaaaagactacactggttgaacagcaaagagaaacccgggtctccagaatcacagtttagtccttctatattactgcaagtgacctgttttttctgaaggctccccgcaaatgaagtcctggaatggaaaaaatccataagtccataaattaacttgataaatattttagaacagacaaaagaaaatattgagtgatgtagttctaatcctcctaatatggaacctggcaagactgaatcattttactgtgaaatatataaacacaatagaatgagccaacatgatggtttctctccagtaagagtttttcttttggaaatgaggttaacctagccccaaatctagcaattctcataaaatccgattttagaattagcctcccagattaatctgaatgattgacttattttttcttaggcaagtcagtaagccacccactagacagccatatccagcaaaataagagaagtttccagatgccaaatgataagccaccatcaacccagcggggaagccttctggttggtttggctgtatgagattcaggaaggccagaatacccaaaattattcacacgacgttaacttattggtactggctaagcaatacatgtatttcctaaaggaggagatggtcttttggttgatttatggacacacttgtttcatctgactgtaaatatattgcatgctttattctgatggtgcactatttcatccagcaagcttttcatctgagaatgtttaatgttgaccttattcttagagcaagtagatctaaatatttttcagctgagttattagggagtcattattctgtggtacaatgctgcaaaaagcatcatgtggaagaatgggaactatgcttactttatgaagtgatgtataacacaatgaaatctgttttacaactactgtgctgcatttaattatcttccatttttgctgttaaaaaaaaaaaatccgttaa

SEQ ID NO: 5260 - DNA, 542 bp, Homo sapiens
gcagatcatgggggctcccttcgaattctgcctactgcatggaggatatagccttatcagtaatgtttcagaagtgttcccaagtgaaggcccagcctgtaatagagattcacaatgttttctctttgaagtgaagcagttttgttcatttcctcccatctcagaatgacttcaaatcctgacatcctcgacagcccaatactttgccacaacctgattacaactctagctctcttatttactggctatatgttattgagaaaaggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataac

SEQ ID NO: 5261 - DNA, 953 bp, Homo sapiens
ccacaagcaaggctttgcctatgttttctcctggctccttctgcctcctgaccaaccctggtgcttccccgtgtggacccctgtgacatggcatgcccttcttgggagctgcagaaacgagtaatgtgagagcctgcaattgtaatcttcataaagtatatcacataccgttcaaaaacatcaagtggcatgttaaataagcttttggagaataagttgagcgtgacaccacaagaagaaaaacagaatccatgacttctcaaaacatgatcttgcttcagatgagaaagctctgtgcttagtttgctgtgagtacttctttgtgtccattgtggcctcctatctaacataaggattcctttccccaagtggtggaacagtgggtaggagagtctgttcatatcccaaaggtgtgccaaaaggatttatcaagaaggggatgacggaggttgctcttccaaaagcgtccagagtcactgagacctgacctgtgtattttgtatcctatccatgtcagcacttctccttgctgccaccgtgtgaagaaggacgtgtttgcttccccttccaccatgattgtaagtttcctgaggcctccccagccatgctgaactgtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgct

SEQ ID NO: 5262 - DNA, 997 bp, Homo sapiens
cgcgcccaccggagcccgggctgagagggacctggggagctgcggcctggccggggcggcgcactcaggtggcctcgcttccctgcgggtcaccgcccgccactcgcacagctaggtttgtcctggttgtggtcaagactggatgatgtaactggctctctaggaagcctcacttggccgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagaccccaatttacctgaaagcagccaataacaagaaaggaaagaaatttaaactgagggacattctgtctcctgatatgatcagtcccccgcttggagactttcgccacaccatccacattggcaaagagggccagcacgatgtctttggagatatttcctttcttcaagggaactacgagcttttacctggaaaccaggagaaagcacacctgggccagttccctgggcataatgagttcttccgggccaacagcacctcggactctgtgttcacagaaacgccctccccggtgctcaaaaatgccatctccctcccgaccattggaggatcccaagctctcatgttgcccttattgtcaccagtgacatttaattccaaacaggagtccttcgggccagcaaagctgcccaggcttagctgcgagcccgtcatggaggaaaaagctcaggagaaaagcagtctgttggagaatgggacagtccaccagggagacacctcgtggggctccagcggttctgcatctcagtccagccaaggcagagacagccactcctccagcctgtccgaacagtaccccgactggccagccgaggacatgtttgaccatcccaccccatgcgagctcatcaaggg

SEQ ID NO: 5263 - DNA, 3100 bp, Homo sapiens
gccagagggaaacaaacgccggcgctgacaggggccgccagcccctccgccgcgcggagcccacgaaggggacagcgcagccggcccagagctcgggtctccggggaccgagccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggctggcgagcccgacggcgagtccttggacgaacagccctcttcttcatcttccaaacgcagtctcctgtccaggaagttccggggcagcaagcggtcacagtcggtgaccaggggggagcgggagcagcgtgacatgctgggctccctgcgggactcggccctgtttgtcaagaatgccatgtccctgccccagctcaatgagaaggaggccgcggagaagggcaccagtaagctgcccaagagcctgtcatccagccccgtgaagaaggccaatgacggggagggcggcgatgaggaggcgggcacggaggaggcagtgccccgtcggaatggggccgcgggtccacattcccctgaccccctcctcgatgagcaggcctttggggatctgacagatctgcctgtcgtgcccaaggccacgtacgggctgaagcatgcggagtccatcatgtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggcccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctgtgttgtcacagcaggaataggttttcctctgttggcctccctttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagaacaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcacagtggcgattagcggactggagtctggtggcgattagcggactggagtctggggacatccgtggcaaagacaccagctcaactttagtgcttcccaactttatttagaatgacatggggtgggtgtctggtgtgtgtgttttccctacgcacctcccatagctattaacaactgaggaaggccagtgcagaatatttttggagaacgattttttttttaaataatatatcattcctatggggggaaagccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtaaacaaaagataattttctagcattaatatgccccacgcaatatttggaacacttatgtgaaaaatgatttgtttttctgaaattcacgtttctctctgagtcctgtaactgtccccgaggggattgagcagaagctcgggtatgagccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcgaatcccgtccaggccaattccagattctaaactgatttttttcatgatattgtcaaaacagtgaggaaacattaaaaaaaaagccctaaagc

SEQ ID NO: 5264 - DNA, 2879 bp, Homo sapiens
acaaacgccggcgctgacaggggccgccagcccctccgccgcgcggagcccacgaaggggacagcgcagccggcccagagctcgggtctccggggaccgagccttatgatctcctcattgcgtccccctctgcccactggacttggacttcagatctgaccccagacctgccggctacctcgggagggcccacctccccgcccatccagcaagatgccaatcctcaagcaactggtgtccagctcggtgcactccaagcgccgttcccgagcggacctcacggccgagatgatcagcgccccgctgggcgacttccgccacaccatgcacgttggccgggccggagacgcctttggggacacctccttcctcaatagcaaggccgcggagaagggcaccagtaagctgcccaagagcctgtcatccagccccgtgaagaaggccaatgacggggagggcggcgatgaggaggcgggcacggaggaggcagtgccccgtcggaatggggccgcgggtccacattcccctgaccccctcctcgatgagcaggcctttggggatctgacagatctgcctgtcgtgcccaaggccacgtacgggctgaagcatgcggagtccatcatgtccttccacatcgacctggggccctccatgctgggtgacgtcctcagcatcatggacaaggaggagtgggaccccgaggagggggagggtggttaccatggcgatgagggcgccgctggcaccatcacccaggctcccccgtacgccgtggcggcccctcccctggcaaggcaggaaggcaaggctggcccagacttgccctccctcccctcccatgctctggaggatgaggggtgggcagcagcggcccccagccccggctcagcccgcagcatgggcagccacaccacacgggacagcagctccctctccagctgcacctcaggcatcctggaggagcgcagccctgccttccgggggccggacagggcccgggctgctgtctcaagacagccagacaaggagttctccttcatggatgaggaggaggaggatgaaatccgtgtgtgaggcggacagtgggtggccaccgggagctcttggctgcatcttctccctgcccccaccccactatgacctttgaccctacggcgcaggggcagccaggacccttgattcagaccatggaccctggaccttgtagatgagggacactggcctggccctcgggtcttcggaggacgtagggggctggcatgggtgccgactggctgcctgacttcatcatgctccctgcacttaggctgcgtgggacaagggctgtgttgtcacagcaggaataggttttcctctgttggcctccctttcctccaccctggcctcaaatggatgccagatgccaaccccagttctggccacgtacagccagcgggtcagcccagaggcagcctcagctccagggctaaggactctcggctcccattttctctgctggcgtttctgctgtgcccagcagtggctgctggggaagcagctgcagcaggagggagacggtcttgcctctcagcccctccctgccccaccccagctcctgccctggaaatctggagccccttggagctgagctggacggggggccagctgcgagcatgtgcactaaacgcagccctttccaggggaagagaacaggatggagaatggaaggaaagccccccaggcttcgtgaattgcaagaagggacccttccaggatgacactaggaacagggctagggcactcgctcagtccctaggggcttgtttgttctttattattgtgtttaaatccttatagagcaatatcaggatggtgttaataggtctgcctcagaatgagaatcaatccttttagaaaacctttatactaagcctcctcttcaaaattcacagtggcgattagcggactggagtctggtggcgattagcggactggagtctggggacatccgtggcaaagacaccagctcaactttagtgcttcccaactttatttagaatgacatggggtgggtgtctggtgtgtgtgttttccctacgcacctcccatagctattaacaactgaggaaggccagtgcagaatatttttggagaacgattttttttttaaataatatatcattcctatggggggaaagccttttttttctttttggctgagttattccctccctcccctcaataccctcagtactgactacttccctttcttttctcaggcctccccccaccgacttttgaggccagggttggccagatttagcaaaaccaaaacagagtgctgagttaaacgcaaatttcaggtaaacaaaagataattttctagcattaatatgccccacgcaatatttggaacacttatgtgaaaaatgatttgtttttctgaaattcacgtttctctctgagtcctgtaactgtccccgaggggattgagcagaagctcgggtatgagccctgaggttgactgccggttatttttctgtcctgggaacagcctgacccacctccctgtctccatgtagccagtgaggggagggggagacacagaaccaaccacagccaggggcgtccccatggcgactgtggcccggcccctcctctcttgcctgactctcctctcttgcctgactctagacactaacttagttccaggttcggtgccctgttggtgctcctgtttccaatagcttaggtcccatggtgggggaggaacctcaggggctatgcagcccccgccagctgccctcgaatcccgtccaggccaattccagattctaaactgatttttttcatgatattgtcaaaacagtgaggaaacattaaaaaaaaagccctaaagc

SEQ ID NO: 5265 - DNA, 5413 bp, Homo sapiens
gaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 5266 - DNA, 5251 bp, Homo sapiens
aaaaaggcagcctatgggctgagcgggggatggggagagaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagt

SEQ ID NO: 5267 - DNA, 2345 bp, Homo sapiens
gggatagggccagcaaggcagggatcgaacgagtgtctggcagccgggagcccagcgaagagagcgagcaagcttaggaaaacgagcgaacatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtggtagcaggccatccagtgaaatgtggagcaggcagtaggaaatatgggactggaggtgagcgagaactgatgtcatgagaaggatgattcatctgaagaactaagtggagagaacaaaaagcaaaggtccctattgacttttgaatgcggcagtcaagggtttaagtgggaagcccacttctcaattttcccaggtagtctgactgtgttgccagcaatgcttgagtgagttatcttcaggaaaaagttctcatttttttgagcagaaagcagtaaaagcatcctatcaagcacaaagaaggctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaatta

SEQ ID NO: 5268 - DNA, 2204 bp, Homo sapiens
gcagcgggaggcaggcagaggtagcagctgccttctcctgggcgggcggaggctattcgcccccatcctctccctgcaccccacccccacagttctcaagccttggtgggggacaaaagcagcccattaggacccccccacactcgcacctctccctgccaagacctctaggagcagcagggcggagagacagagcctgccggttggcatggaacaaactgactgaaggcgaggtccggggcggaggggattgggttgtagggctgtggaggaggggcggcggagggggcgctggggctctcgcttgcttcagcccagcccttctagtcagcccgcgacaactcgcgccagctacggggcctcagagaagccggacttcgcaagcaccatgcagtggataaggggcggatcgggaatgctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaactcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagaca

SEQ ID NO: 5269 - DNA, 1059 bp, Homo sapiens
agccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtctt

SEQ ID NO: 5270 - DNA, 4845 bp, Homo sapiens
atctaactccagcgcagcgggaggcaggcagaggtagcagctgccttctcctgggcgggcggaggctattcgcccccatcctctccctgcaccccacccccacagttctcaagccttggtgggggacaaaagcagcccattaggacccccccacactcgcacctctccctgccaagacctctaggagcagcagggcggagagacagagcctgccggttggcatggaacaaactgactgaaggcgaggtccggggcggaggggattgggttgtagggctgtggaggaggggcggcggagggggcgctggggctctcgcttgcttcagcccagcccttctagtcagcccgcgacaactcgcgccagctacggggcctcagagaagccggacttcgcaagcaccatgcagtggataaggggcggatcgggaatgctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagt

SEQ ID NO: 5271 - DNA, 6423 bp, Homo sapiens
tttcttccattctgttttggacatgcgcggggcgtaaggcgctttggccagagtggtttgatggttttgtgttagtcttcctgcagctgagcttccacaagacactttttccctttcagccacccaatatctcgcgagacttgctattctgcgccccctcccaccttgcgcttgcgcagatcttcaaagcagaaggtcgcgcttggaggaagtggcggctttgagtccggtggcccaatcgctgttactacttctctgaagctcctctcggctgcttgccgagacaccctgccgccaagatgcctcgaattatgatcaaggggggcgtatggaggaataccgaggatgaaattctgaaagcagcggtaatgaaatatgggaaaaatcagtggtctaggattgcctcattgctgcatagaaaatcagcaaagcagtgcaaagccagatggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctggataaagctgcccaaagagacaatgaagaggaaacaacagatgatccacgaaaacttaaacctggagaaatagatccaaatccagaaacaaaaccagcgcggcctgatccaattgatatggatgaggatgaacttgagatgctttctgaagccagagcccgcttggctaatactcagggaaagaaggccaagaggaaagcaagagagaaacaattggaagaagcaagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatctgaaaaagaaggaagagatagaaaaaaagacaaacagcatttgaaaaggaaaaaagaatctgatttaccatcagctattcttcaaactagtggtgtttctgaatttactaaaaagagaagcaaactagtacttcctgcccctcagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggaagcccagaacctcatggccctcaccaatgtggacaccccattgaaaggtggacttaataccccattgcatgagagtgacttctcaggtgtaactccacagcgacaagttgtacagactccaaacacagttctctctactccattcaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggaaagagaatcccgagaacatctccgtttagggttgttgggccttcctgcccctaagaatgattttgaaattgttctaccagaaaatgccgagaaggagctggaagaacgtgaaatagatgatacttacattgaagatgctgctgatgtggatgctcgaaagcaggccatacgagatgcagagcgtgtaaaggaaatgaaacgaatgcataaagctgtccagaaagatctgccaagaccatcagaagtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggcccaggatgttttggtgcaggagatggaagtggttaaacaaggaatgagccatggagagctctcaagtgaagcttataaccaggtgtgggaagaatgctacagtcaagttttatatcttcctgggcagagccgctacacacgggccaatctggctagtaaaaaggacagaattgaatcacttgaaaagaggctcgagataaacaggggtcacatgacgacagaagccaagagggctgcaaagatggaaaagaagatgaaaattttgcttgggggttaccagtctcgtgctatggggctcatgaaacagttgaatgacttatgggaccaaattgaacaggctcacttggagttacgcacttttgaagaactcaagaaacatgaagattctgctattccccggaggctagagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattgagaatgtagccttttgtttgaagtaattagatacttaagagtgcctgcaaaccagcagctatgtactctgtgtcatatttaatgagtaactcttgggtaatcaaaatggtgatgcagtatcttaaacacttaagaggcagttctttgtggctttgttagtttcagcaaagagtggtcatttctgtatacactgacaagttagattaactttttagtacctcaaattttttttttgttaatatcactttaaagaaggtctcttgtctgccagctacttaaataatttatgggtcagggcttaaaagatttaacttccttgccccattattttcttataagtattttttgacaaaggcattttaaaagttaatttcaagaaggccatcaaacttaaagctctatgtttagcctaagaagtcagttacatcagtgtagaatttggggaatggatagaggtggagatatttaattttatataattcatataaattgatttagttacagtatcagttggctacaagctcattatagactagcaatgttttgacatcaccaaaaacgtttgcccagtcttagaatactagggactataggaagggaagggattcattcattcattcgatattgaatgtataccctgtgccagagtcttagagagagaacaacaaacaaaataggcctagttcttgtttagtagagcttatagtcttttgagaatgacagacaattaaaatccaaatgtttatttggtgattcttatgtgtcagacacttaagtgttgggagataagcagttattaagacagagttcttgctctcatggaggtgacattagtggggaggagatactaagtatgtccagggaaagtatcagaccatgagttttagattctgtggaggaaattaaagtagggtgattatgagatagtgaatgagtggctattttagactggacgatcaaagagacctcttggaaggcagctatgctcaccactataccactgcactgtgccgcaccgtaccactataagctgcacggccaaagagacctcttaaagaagtaacatttaagataacatgtgattgacattttagaatgggctatccttgtgagattcaaggaaagaacatcctaggtggagtgaatagcaaacataaagcctcttttgtatgtttgaggaacaaaaaggacaatgcagctagagtgtcaagaatggcatttctgtatataagacctcgttgtatagagccacataaataaggctataataaggaatttggatcttactttaaatatgataagaatcgatgagaagatctaagcaaaggaatgacatgatcagatttggttttagaaacatcactatctccttagtgtgtaaaatctcaccaggctggagatagggaagccagtccaattaggagcctgatgcagtgatccagacaaaaaaataatagtgattctaactagagtccaggtaatagtagtggagatatgtggagagacatgataggtatatacttaatagtcttatcagacgataaattgatattttcctggtgtgtagtcacttaattcaaatacttttttcagtaagttctgggttttctaggaaaaacttcagtatcatcagtgaataatgatagtgtttcttctgatagttttatttcacttttattgcatgttttgttatctgaaatgtttaggacaatgttaacaataatgatgttagacatttttttttcttattttaatgggaatgtccatagttttaagtttgctgttgggagttagatagtctttatctgaaagacagtgtctctcttttagtttttaaagagtttgaattagaaatggctctggaactttaaacagtataccatttgggcatctattaaagcattcatataattgttctcatttgatgttttgatgaggtatattaatagattttcccacattaaatcatctttgcactcctggaatcaggtagattaatttttaaaagaaattttaaaggatttatagtttatttgcactttttgtagacttgaattatatggatttaaaagttgatctaatattaataaaggctcactttgttttcaaaatttgaagtaattcacatacttatagcctaaaaaaatcggcaggaattacaaaatttcaaaactggcacattgtaaactgcatatgcatttgccaggtagtggtgccacttgaaatggtgaacagacacactgttatcctttgtcagtatcctgtaaagcccaggattctttaccagcaccatacagcgattttggtgactattttaacattcacactgaggccaggggtggtgagtcatgcctgtaatcctagcactttgggaggccaaggtgggaggatcatttgagctcaggagttcaagattagcctgggtaacatagtgagaccctgtctctattaaaaaataataataaaaataacattcacattggtattgttcactaaggtattggttgttaaggcattcattaaggtattgttaaaacttgtgttaagcatgttaaagtctcagtaactttgggatagaaataaaatgtgataaaaagctgaaagaaaccaccacaagggagagtcctttttgaaatattagagacataatgctgtctaataaaaaacgacatcaaagaaaaactacactacagtgactgcagacttaatgttggccaaccatgcatcctccctagaaatgcatttgaatttgatttactaatcttttatttaggaaatttacatttttacattagtgagattggtcttttgggctattgtacttttttttttttttttttgagatggagtcttgctctctcacccaggctggagtgcagtagtgcaatcttggcccactgcaacctctgcctcctgggctcgagtgattctctgcctcagccttccaagtagctgggactacaggcatgtgccaccgcacctggctaatttttgtgtttttagtagagatggggttttgctatgttggccaggctggtcttgaattcctgacctcaggtgatccacctacctcggcctcccaaagtgctagaattacaggtgtgagccaccatgcccagcctggttattgtattttgatattgggattttgctagctctctaaagtaaataggataactgtatatctttttctgtgcattaagcagttataacatgggaatgatttgttcatgaaaggttgaaagtctgtacttacagaacttttgagttcacagtgctttctggaaataatttctttataactgtcagtttcttttgtgactattatgttacctatttttaaatttaagcaactttaaattaaaaaaattgtttttaaaatat

SEQ ID NO: 5272 - DNA, 1888 bp, Homo sapiens
gtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggaagagtcaccgaaggaaaagaaccaggagtgtagaggatgatgaggagggtcacctgatctgtcagagtggagacgtactaagtgcaagatatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaagttgatatgtatctgaacagtttgttctaagtaccatttttcttcctacttctattaaagaatggacataga

SEQ ID NO: 5273 - DNA, 1843 bp, Homo sapiens
gtgcatgacccgccccgcggcggagacgcgctcgctgcgtcatcagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaagttgatatgtatctgaacagtttgttctaagtaccatttttcttcctacttctattaaagaatggacataga

SEQ ID NO: 5274 - DNA, 2026 bp, Homo sapiens
aagacgcaggagggagcggactaggtgacagggccgttcctgtgagcctcgcgggcgcctggcgatgcccccttttcctgcttgtttgctgcccgccgtccccggcgcgacgactgcctgctcccttcactcccaggctgcacagtggcggcgcgcccctctttcctgcgcggccgagcctgtcgccgccggatccggcctgcgggggtagttacggtgtttgctaggccggccgccctcttggagcttctgccctccgctgaggaagcggcgccgcctgacgcgggacggtcgggcgggcgccatgttgtgaaccgcctcggcggagctgtaagatggcggctgggcggaggccggcttcggccctgtggccggaaaggcgaggctccccgttgaggggggatttgctggggttccagaatgtgcgtgagccaagcagctgtggggaaacgttgtctggaatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggaagagtcaccgaaggaaaagaaccaggagtgtagaggatgatgaggagggtcacctgatctgtcagagtggagacgtactaagtgcaagatatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattg

SEQ ID NO: 5275 - DNA, 2120 bp, Homo sapiens
cggcggcggcggagcggagaggccagagccggagaccgagctgggatcgggccccgggcgggggcggtgcgagcggcgccaagcagatcttaggggcggggacggagccggggcgggcgggactgaagcggagcccgggaacggggcgggaggtcccagggtcccgggttgggggggtggagcagcatttcgtcgccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcacagcagccggagagccaagagtgtagaggacgacgctgagggccacctcatctaccacgtcggggactggctacaagagcgatatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttga

SEQ ID NO: 5276 - DNA, 1934 bp, Homo sapiens
ccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcacagcagccggagagccaagagtgtagaggacgacgctgagggccacctcatctaccacgtcggggactggctacaagagcgatatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttgaccccca

SEQ ID NO: 5277 - DNA, 2166 bp, Homo sapiens
ggacgtcggtccgtgcgtacgtgctcgctcacggcggcggcggcggagcggagaggccagagccggagaccgagctgggatcgggccccgggcgggggcggtgcgagcggcgccaagcagatcttaggggcggggacggagccggggcgggcgggactgaagcggagcccgggaacggggcgggaggtcccagggtcccgggttgggggggtggagcagcatttcgtcgccgcgggggtgccgggactccggccgcagtgtcgccgccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcagcacagcagccggagagccaagagtgtagaggacgacgctgagggccacctcatctaccacgtcggggactggctacaagagcgatatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaatatgaaagaacttgtacctatcacttcaacccctgccttgtacataatactattccatccacacagtttccaccctcacctgccccctcatacggagttggatgggggccgagtgaggtaaccaggtggcatctaccccatgttttataaggaattttgtacagtctttgtgaaataaaataacgtgcttcatttgaccccca

SEQ ID NO: 5278 - DNA, 1599 bp, Homo sapiens
acggcggcggcggcggagcggagaggccagagccggagaccgagctgggatcgggcccccatcacggacttcctgtgggacaagcgcacgggcctcgccgccagaacgatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaaga

SEQ ID NO: 5279 - DNA, 1711 bp, Homo sapiens
agatttggggatcggacctgaggccgcggtcgcaggcgggggagcaacgggaggcaccgcctccagtccaggggtcgccccttcgctggcccccgccgccggccgctgctctgcctccatggcgcccaccccgcttacacgctcggcctcctagagccctctgtggccatcagatgccgcatcctcgaaggtaccactcctcagagcgaggcagccgggggagttaccgtgaacactatcggagccgaaagcataagcgacgaagaagtcgctcctggtcaagtagtagtgaccggacacgacggcgtcggcgagaggacagctaccatgtccgttctcgaagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcgcagcacagcagccggagagccaagagtgtagaggacgacgctgagggccacctcatctaccacgtcggggactggctacaagagcgatatgaaatcgttagcaccttaggagaggggaccttcggccgagttgtacaatgtgttgaccatcgcaggggtggggctcgagttgccctgaagatcattaagaatgtggagaagtacaaggaagcagctcgacttgagatcaacgtgctagagaaaatcaatgagaaagaccctgacaacaagaacctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagttcctccatgataacaagctgacacatacagacctcaagcctgaaaatattctgtttgtgaattcagactatgagctcacctacaacctagagaagaagcgagatgagcgcagtgtgaagagcacagctgtgcgggtggtagactttggcagtgccacctttgaccatgagcaccatagcaccattgtctccactcgccattaccgagcaccagaagtcatccttgagttgggctggtcacagccttgtgatgtgtggagtataggctgcatcatctttgaatactatgtgggattcaccctcttccagacccatgacaacagagagcatctagccatgatggaaaggatcttgggtcctatcccttcccggatgatccgaaagacaagaaagcagaaatatttttaccggggtcgcctggattgggatgagaacacatcagctgggcgctatgttcgtgagaactgcaaaccgctgcggcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcag

SEQ ID NO: 5280 - DNA, 1846 bp, Homo sapiens
ggggcactggtacctccaggacctggagtgtactggaagaaatggtgcagtccagatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagcagttca

SEQ ID NO: 5281 - DNA, 1634 bp, Homo sapiens
agctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgt

SEQ ID NO: 5282 - DNA, 1662 bp, Homo sapiens
agctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgt

SEQ ID NO: 5283 - DNA, 2621 bp, Homo sapiens
agttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggt

SEQ ID NO: 5284 - DNA, 2695 bp, Homo sapiens
agttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagcagttc

SEQ ID NO: 5285 - DNA, 2479 bp, Homo sapiens
ggagtccagacttccttatggccaggacagctccacgcatgctcagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaaaaaaaggaaaaaccaacctgcatggcctgtgggttattttggtcttgtaaggatccatttctttaaaatactgacatatagagttgtaccttatatagaatatagttgtatcttgaagtcaacatattaaattattctcaaaattatgtatttgcagattgtacttgtaagtttcaaagaaaaattaccatcttttcatattgacctggaaactaaataggatgtgattcagctacattaatttcttaatacaatctaggaaagacctgttgtagccttgattttcttgacattggtaatgacactgagaaaatatggcttctgtttttcaccgttttcaatcaaaatgattgataaatgttattctgtttaatttcataagtcaggtcaataataaaggggtggtaacttcctcatatttatcttcacagatatttaatgaagatggatccattaaaggagccaatagtgaaaatttagttaaaggtgatattagatttaaattagtcatgaagaatgtcttaaaatctaatgttccagaattctggcccaaggaatggtaagcacttgaactgaggattttgaaggaattggaacatataatgtcaagtcttttgatcactaagccacatatcctgacagaaatagtagtcacaagattagatcaaaggcgtgggaagatttttttttttcccactctagctaatcaagcacatggcttttaaattgtatgatctttttcttaaaagcaaaaatttgaagacaagtgtttgtttatgtaatattcttcaaagactccgagcagaaacattgcattcattgttgattcagaaaaaagaaaatataaaaactgaaaataattagcaataaaagatttaagacaaatagttcataaatatttttaaagagattaggtttttgaatttcataggttagaaggaaaatcatggcaaaatttacagaaaattgggcaaacaattgaaattgataaagcaggtaaacatcatcatttattttagtatacatgaattctcagtagtagtcaatcacaaatttctacttgctaaaatccatttaccttgacaggaatcaaacctgacagcagcatatcctatgtaatatatgatcatggctatttttaaatatgtagttttgtgtattactgtagataaaagttggtaacaaaattgtacagtggttttaagaagcccatgtaactaacttggacatgtctttaagtcacatattcatcataaaatctaaaatcctacaaactgattctattagattcttagggtaaattttttctttgcccacctccttctttttaagataagtatgcatgtcagcaaaacagagcaatcatgcttttaaagatgaactgttttaaagaaaaataaatgcatcaactcccagtgtttctgataaagggacatccttctaacttaacagactattctttatcttgaatttgaaattatattgttagtcatgcatttttgtaatgtcagggggaacctggtaccagttctcaaaactataggattatatgagtgtgtgtatacatatggcaaaattataaatgaccaccttactgtgaaatatagatcttgagcattttgaaaggccaaaataattaggtaaatgtattttcaaggtcatgttaaaatgtttacatgcttttgaactagcattcatttatgattaaaacccttttcaggttatttgacctaaaaaccaaa

SEQ ID NO: 5286 - DNA, 2327 bp, Homo sapiens
aggccgaggccgccagtgcccgccggccgcttccgctcccggcgcaggcgcggcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacgtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtgtattttaaactgactcagtgacagctggggtggaatggcaagaacacttacaaccaaactcatgggctgctgcaatttgaagataattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaattgtacccacccagttcaaacccgtgtgtaagggtcaactgtacaaaaaagtttgtgaaataaacgtactggagaatctttaaaatttttgtgctttttaatcctactattatgaatctttttagtttcatcttacattactactctcataatagctatccttagccaggtgccatggcacaggcctgtagtcccaactgctgggaagattgaggtgggaggatggctgcagtacaagagcccaggagttcaaggccaggctgggcaacctagtgctccgcctctgctgggctctgtagggaatcctttctgttgtaaaagagttaccatttaactcccttcactgagtgcgtttctgagaccttgctaggcactctggaaactgcttagttgagaaaagacaaatacaaaagcttttctttagtctatttaagatacagtttattcagttcactttgctttctttttataagaatgtacaagaggcagacagaggtaatccttctagaaataaaactaattgttattgggcacttgtatgtaccagacactacactaagcatggtacttgggtttttaatttattacatgtaatgtcagtaggttcaattatatgatcgtaacatcttcatgaccagcagcatgtattttagagttagaaatgtagtctggtttttgagaagttttacaaggtgtatgtccaaaattgttctttcctcacatgtcagtgggggataaatacagcattgctctca

SEQ ID NO: 5287 - DNA, 2636 bp, Homo sapiens
gccgcggcgtcttccggggcctggcgggccggggaccgagggggcggggaggtgacccggcgggggcggagccagcgggcgggcgcggcgcgggaggcgaccatgcgcggcgcgggggcgatcctgcggccggcggcgcgtggtgcccgggacctgaacccgcggcgggacatctcctcctggctggcccagtggttccctagaaccccagccaggtccgtggtggccctgaagacccccatcaaggtggagctggtggcagggaaaacctacaggtggtgtgtgtgtggccgcagcaagaagcagcccttctgtgacggctcccacttcttccaacgcactggcctatctccactcaagttcaaggcccaagagacccgcatggtggcactctgtacctgcaaggccactcagaggcccccgtactgcgatggcacccacaggagtgagcgcgtgcagaaggcagaagtgggctccccactctgagggggctgctgctgtccagccacaggtggccttggctccaggcctctgacaggcacccccttctgtgggaaaggaaacaggtgctgagcccaagagactctggtacccactgctggctcatgaaggaagaattattccttataacctaaaagtctccagtctggggcaggcgggagtgggccctggttcaatgtttgctgatggggaagatggcaaaaacaagcctgcccaaccagactggtagtcctgcagtcactgctatgaggcccacgtgctgcctcctgctccagattttaacctctctgtgggctgggggcacctgaccagccacaggagagggcagttcagattcattctgtatggggtccccaagccaggctaaacccagagatgagaggcacccttcccttcttccctccaccccaaagaactacaggctccagaaagtatgcagcatttattacaaagccaagagatacagatgtcccagggcaaaggagggtacagtcacaggacctcagacacaggacaaggtgcaaacacagacaagcccatcagggggctcccaaccccacacacctacgctatgatggaatctcgagtctcgactcccgactcctctcagatctatgcacacttgaggaaatctcggtgggcagcgacctgccagggtctgtccctaaggaggtggtccgctgacctctcaaggggtgggggtggggtcagagcttacaggtttctgtcttcttgtgcttttagatgcagttgctctgtcctgaccaggtgaccgggcctcagctgggggtggaggggcaattggaaggctgtttgcctctggcaaagtctgggatctgtgcttgtgtgaggttaacccacccccacttccactctaggccccaggtgagactccaccaccagtcctgctagtgagggttccccggtgagggtaaggttggtgggggtgcagcgcttcacaatgctaaagccttagccctcctccaagagctgagacctctcagggcctgaatcttcttttccacaagataaatgatgcaaaggccacacacacaggaaaaaaaaaaaaagaggcagaactatctattctttgcacaaagtttccactgcaagaggaggaggtgatgcaggtgccacctccaccctgcacttgctcctcagaaccagggataaactgcatttgtaaaaggcactgttcttagcaatttctggacattcaacaacgtggggggcggccactggtcagaggcaggacagcagccaagatggggagagaaacggggagagaaagaaacgattctaactgactcctatatgcagccagttggaatcatgcctaaagctttgggtctgaaggggcccccaacacaccacctgccttgggaaacagcgaggatggtgcagagctttattgagactccagtggcccatccagttcatctccaggcacccccaaaaacagcaaattacacaagaccccccccaaaaaaaatgaacaccattttccacacatacacacacacataaagtttgtttcctgtggcatttaaattaatctggttggtccatagaaaataagtatgtatatttggtttttcctatgtacatatatatatatatttatttataaaacccgccccccacccccaaggtgggaagagctggggaaagtagaagaggtggaaaaaagggcccagaaaaagtggaaggagtggagaggcttggctggaagaagggagagggtccctggcctcaagttaaggggggcacgggagcgccgttgacagtcatcttgcgccccctgctggtggaggatggtgtctgcaggcagttcaagctacccccgttggcagctgtggtggccccactggctgtcgaagggggagtgggggaggtagggtgggtggctggaggcccatgggaactgggagagccatgggatggggtggctgggctgggcagggaggaggaggtggctggcagggtggcagggctgggagccttgtcgctgactgactcacactcggacgccccgctggtgttggtgccctcggagggggtgggcaccgtggctagggtgagccgcttgcaggctggctggacacggtacttgagggggagaggcccgttctgcg

SEQ ID NO: 5288 - DNA, 3272 bp, Homo sapiens
aaataaacgtggcgggacgtatgtgtcatggcgctctccatctaaagtctgtgcagcttccggagagtggcgggttgattttctcactttggactggtttttacttcccgacttctggactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgaaaaagcaaaggacaaaagatctttctcgggtgtttcattcttacagtccatatgatcacaagattggtgaaagacaacaagtgttagtaacagaagaatcttttgattccaagttttatgttgcacacaatcaattctatgagcaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcatttttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttttgtgttttcagtagagacggagtttcaccatgttggccaggctagtctcgaactcctgacctcaagtgatccgcccgcctcggcctcccaaagtgctaggattacaggcgtgagccactgcgcccggcctctttaataaatatttttaagtgcatcttccccttcaggctttgtttggagtcccagtgctacaaacattgtatttttcacagcagatgtgttcctgaaaagtgtatagaaacctgttctgggaacctgaatgcttttggaatgcacggggagagtctgccagctaaaggactcctggcaacattctgtgaaatatgaaactggaaaactggatttgtcgaaaactaattgtgcccattttctcacatttttgatccattggggttttttttttgtttttgtttttttttttttttgagtcaaggtctcactctgtcaccctggctggagtgcaatggcactatcttggctcactgcagccttgacctcctggactcaagcagtcctcctacctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatagaattggtatactaagcaaa

SEQ ID NO: 5289 - DNA, 3115 bp, Homo sapiens
ggtagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagcactattccaggcatacagaaaatttggatacgaacatggggttgttctcataataattcagatggagaatatatggctggacagctagctgcttatggctataaaattacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgaaaaagcaaaggacaaaagatctttctcgggtgtttcattcttacagtccatatgatcacaagattggtgaaagacaacaagtgttagtaacagaagaatcttttgattccaagttttatgttgcacacaatcaattctatgagcaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcatttttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttttgtgttttcagtagagacggagtttcaccatgttggccaggctagtctcgaactcctgacctcaagtgatccgcccgcctcggcctcccaaagtgctaggattacaggcgtgagccactgcgcccggcctctttaataaatatttttaagtgcatcttccccttcaggctttgtttggagtcccagtgctacaaacattgtatttttcacagcagatgtgttcctgaaaagtgtatagaaacctgttctgggaacctgaatgcttttggaatgcacggggagagtctgccagctaaaggactcctggcaacattctgtgaaatatgaaactggaaaactggatttgtcgaaaactaattgtgcccattttctcacatttttgatccattggggttttttttttgtttttgtttttttttttttttgagtcaaggtctcactctgtcaccctggctggagtgcaatggcactatcttggctcactgcagccttgacctcctggactcaagcagtcctcctacctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatagaattggtatactaagcaaa

SEQ ID NO: 5290 - DNA, 3096 bp, Homo sapiens
aaataaacgtggcgggacgtatgtgtcatggcgctctccatctaaagtctgtgcagcttccggagagtggcgggttgattttctcactttggactggtttttacttcccgacttctggactcatctttcaagaggactttagactaattgcagataattaagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacagaaaatgcatccgatgcagatttatggctcctgaacagttgcactgtaaaaaacccagctgaagaccactttagaaactcaattaaaaaagctcaagaggagaacaagaaaatcgtactggctggatgcgttcctcaagcccagcctcgccaggactaccttaagggactgagtatcattggggttcagcagatagatcgtgtggtagaagttgtggaggagacaattaaaggtcactctgtgagactgctgggtcagaaaaaggataatggaaggcggcttgggggagcacgattggatttgccgaagattaggaagaatccactgatagaaatcatttccatcaataccgggtgtctcaatgcttgtacctactgcaaaactaaacacgccagaggaaatttggccagttatccaattgatgaactagtagatagagccaaacaatcttttcaagagggtgtttgtgagatatggttgaccagtgaagacacgggggcttatggcagagatattggcaccaatctccccacactcctgtggaaactggttgaagtgattcctgagggagcaatgctgaggcttggcatgacaaatccgccctatattttagagcatctggaggaaatggcaaaaatccttaatcaccccagagtctacgcttttctgcacataccagtccagtctgcctccgacagcgtactcatggaaatgaaaagagaatactgtgtggctgacttcaaaagagtagtggattttctgaaagagaaagttcctggaataactattgctacagatattatctgtggttttcctggagaaacagatcaggattttcaagaaacagtgaaacttgttgaagagtacaaattcccaagcctgtttattaaccaattttacccaagaccaggaactcctgctgcaaaaatggaacaagttccagcacaagtgattggtgaaagacaacaagtgttagtaacagaagaatcttttgattccaagttttatgttgcacacaatcaattctatgagcaggttttagtgccaaagaaccctgcgttcatggggaagatggttgaagtggacatctatgaatcaggcaaacattttatgaaagggcagccagtatctgatgccaaagtgtacacgccctccatcagcaaaccgctagcaaagggagaagtctcgggtttgacaaaggacttcagaaatgggcttgggaaccagctgagttcaggatcccacacctctgctgcatctcagtgtgactcagcgagttccagaatggtgctgcccatgccaaggctacatcaagactgtgcgctgaggatgtccgtgggcttggctctgctgggtcttctttttgctttttttgtcaaggtctataattagaatacaactaatggaaacatctataaagaagaatacatttctaattaaaatcttcaatgaacaggaaagcgacatctccattctccaagggcaataatttgtactggtcatgctgcctccttctcagccactcttcttaatgaggctccccctgtctcacattgagttgggcccattggttatttgacctaaaacctaatcaccgctaccatagcacatccttcaaattaaactgcttttggtttacttttagcaagaaatgcaagcggttgcatttttttctgtttgtttcaatctctaatctttaagtcagaacctaattgtacagtggctctggccatcttttcctcatgtggaagaattttctatctttaataaactttttctttgttttttttttccagatggagtttcgctcttgtcccccaggctggagtggtgcagtggcacgatctcaggtcactgcaacctctgcctcctgggttcaaacgattctcctgcctcagcctcccaagtagctgggattacaggcatgcgccaccaagcccagacaatttttttgtgttttcagtagagacggagtttcaccatgttggccaggctagtctcgaactcctgacctcaagtgatccgcccgcctcggcctcccaaagtgctaggattacaggcgtgagccactgcgcccggcctctttaataaatatttttaagtgcatcttccccttcaggctttgtttggagtcccagtgctacaaacattgtatttttcacagcagatgtgttcctgaaaagtgtatagaaacctgttctgggaacctgaatgcttttggaatgcacggggagagtctgccagctaaaggactcctggcaacattctgtgaaatatgaaactggaaaactggatttgtcgaaaactaattgtgcccattttctcacatttttgatccattggggttttttttttgtttttgtttttttttttttttgagtcaaggtctcactctgtcaccctggctggagtgcaatggcactatcttggctcactgcagccttgacctcctggactcaagcagtcctcctacctcagcctccctaatagccaggggctacaggcatataccaccatgcccaactaattttttaattttttgtagagatgagtgtcactatgttgcccaggcttgcctggaactcctagcctcaagcagtcttcttgcctcagcctcccaaagtgctgggattacaggcgtgagccactccacccagcccagattaaatgtttttatttctacctgccatcattggtctttactaagtgaagtgacttctttctttaacaataaatagaattggtatactaagcaaa

SEQ ID NO: 5291 - DNA, 5002 bp, Homo sapiens
aggaagaagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggcaaaagatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagaggaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgaaaaagtca

SEQ ID NO: 5292 - DNA, 6228 bp, Homo sapiens
ggaagaagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttcaccttg

SEQ ID NO: 5293 - DNA, 6107 bp, Homo sapiens
aggaagaagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttcaccttga

SEQ ID NO: 5294 - DNA, 5985 bp, Homo sapiens
ggaagaagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttc

SEQ ID NO: 5295 - DNA, 6134 bp, Homo sapiens
aggaagaagcgccgggaaagatggcggcgtctgtggtttgaattccagcggcgccgccagagtctgaacaagagctggggtggagggggcggggacctggggagcccggcgggtcgctatcgcggggggtactagtggcgccgccgccacagacaccaacgctgtcgccacctctgtagccatgatggacttggtgttggaagaggacgtcaccgtccctgggacgctcagcggctgcagtggccttgttcccagtgtaccagatgacctggatggcatcaaccccaatgctgggttgggaaatggtctgctcccaaatgtgtcagaagaaacagtgtctcccaccagagcacggaacatgaaggactttgaaaatcaaatcactgaattgaagaaagaaaactttaacctaaagctccgcatctatttccttgaggaaagaatgcaacaggaatttcatggccccactgaacatatctacaaaactaacattgagctcaaggtggaagtagaaagtctgaagcgggaactccaggagagagagcagctgctcatcaaagcctccaaagcagttgagagcttagctgaagcaggtggctctgaaatccagcgggtgaaagaagatgctcgaaagaaggtgcagcaggtggaagatctcctaactaaaagaatactccttttggaaaaggatgtgacagccgcccaggcagaactggaaaaggcctttgcagggacagagacggagaaggctcttcggttgcgtttggaaagcaagctttcagagatgaagaagatgcacgagggggacttggcgatggctctggtcctggatgagaaagacagactgattgaggagttgaagctgtctttgaagagcaaagaagctttaattcagtgccttaaagaggagaaatctcagatggcatgtcctgatgagaatgtgtcatctggagagctccgaggactttgtgctgctccaagggaagaaaaggagagagaaactgaggctgcacaaatggagcatcagaaggagagaaacagctttgaagagaggatccaggcacttgaagaggacctgagagagaaggaaagagaaattgctacagagaagaaaaatagtctaaagagggataaagccattcagggtttaaccatggcattaaaatcaaaggaaaaaaaggttgaagaacttaactctgaaattgaaaagctcagtgctgcctttgctaaagccagagaggccctacagaaagcacagacccaggaatttcaggggtctgaagactatgagactgctctatcaggaaaggaagccctttcggctgcgctgcgctcacaaaacctcaccaagagtacagagaaccacagactgcgtagaagcattaagaagatcacccaggagctgagtgacttgcagcaggagagggagagactggagaaggacctggaggaagcccatcgagagaagagcaaaggagactgcaccatccgtgatcttagaaatgaagttgaaaaattacgcaatgaagtgaatgaaagagagaaagcaatggaaaatcgttacaagagtcttctgagtgaaagcaataaaaaattgcacaatcaagagcaagtgatcaaacatctaacagaaagtaccaatcagaaggacgtgttgcttcagaaattcaatgaaaaagatttggaagtaatacagcagaactgctatttaatggctgcagaggatcttgagctcaggagtgaaggcttaataacagaaaagtgctcttctcaacagccaccaggcagcaaaaccatcttctctaaggaaaagaaacaatcatcagactatgaagagctgattcaggtcttaaagaaagagcaggacatctatacccatctggtcaaatctctgcaggaatcagacagtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctgagaagaactttcagccaataaagcttgtgcttcccccaccgagctcacgctgtctctttgttccaagtgtggttcctatttattgaggaagaaagagctgtctggccaaaggaaatctattttttcccttcatgttttctctctgaaagttggcttgagagttgttgtcagaaaggtgcaggtgctccacaaacgggtggtaaaaaggcctcgagctcttggatgttgtatttcagatcaggggcaggcaccggagttgaggctgtgcgccttggtgggcttcacgtcttcccctggatttgcttagtactcagccagtgccacagtttgaagattctcattaaatgattcatttcatttcaccttga

SEQ ID NO: 5296 - DNA, 1884 bp, Homo sapiens
cggaggctcggccacaacgccactggattggtggtagggcggggcgggccacagtctccagcctgaagcggaagtggaggaaagatggaggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctacttagtggaactctctagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacgggcgaaaatgtccgaggagaactgctggccctggtgaaggacctgccgagtcagctggctgagattggggcagcggctcagcagtccctgggggaagccattgacgtgtaccaggcgtctgtggggtttgtgtgtgagagccccacagagcaggtgttgccaatgctgcggttcgtgcagaagcggggaaactcaacggtgtacgagtggaggacagggacagagccctctgtggtggaacgaccccacctcgaggagcttcctgagcaggtggcagaagatgcgattgactggggcgactttggggtagaggcagtgtctgaggggactgactctggcatctctgccgaggctgctggaatcgactggggcatcttcccggaatcagattcaaaggatcctggaggtgatgggatagactggggagacgatgctgttgctttgcagatcacagtgctggaagcaggaacccaggctccagaaggtgttgccaggggcccagatgccctgacactgcttgaatacactgagacccggaatcagttccttgatgagctcatggagcttgagatcttcttagcccagagagcagtggagttgagtgaggaggcagatgtcctgtctgtgagccagttccagctggctccagccatcctgcagggccagaccaaagagaagatggttaccatggtgtcagtgctggaggatctgattggcaagcttaccagtcttcagctgcaacacctgtttatgatcctggcctcaccaaggtatgtggaccgagtgactgaattcctccagcaaaagctgaagcagtcccagctgctggctttgaagaaagagctgatggtgcagaagcagcaggaggcacttgaggagcaggcggctctggagcctaagctggacctgctactggagaagaccaaggagctgcagaagctgattgaagctgacatctccaagaggtacagcgggcgccctgtgaacctgatgggaacctctctgtgacaccctccgtgttcttgcctgcccatcttctccgcttttgggatgaagatgatagccagggctgttgttttggggcccttcaaggcaaaagaccaggctgactggaagatggaaagccacaggaaggaagcggcacctgatggtgatcttggcactctccatgttctctacaagaagctgtggtgattggccctgtggtctatcaggcgaaaaccacagattctccttctagttagtatagcggacttaataaaagaggaaaaaactcttgcttcagta

SEQ ID NO: 5297 - DNA, 1964 bp, Homo sapiens
aatgtaggtgttctctttgggacgtctcaccgactctcttccttccccttccctgccctaatcgcccaacacgttgcaggtgctcaaccatgtctattagagaaactgaatgaggaggcaaagcatgacaagtgccacaagagacctgcacactgctctggatggtaaagcgacgcaaggagggaagaaggaccatcagcacgtgcccatcgacatccagaccagcaagctgctcgattggctggtggacagaaggcactgcagcctgaaatggcagagtctggtgctgacgatccgcgagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggattggcaggagattatagctctgtatgagaaggacaacacctacttagtggaactctctagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacgggcgaaaatgtccgaggagaactgctggccctggtgaaggacctgccgagtcagctggctgagattggggcagcggctcagcagtccctgggggaagccattgacgtgtaccaggcgtctgtggggtttgtgtgtgagagccccacagagcaggtgttgccaatgctgcggttcgtgcagaagcggggaaactcaacggtgtacgagtggaggacagggacagagccctctgtggtggaacgaccccacctcgaggagcttcctgagcaggtggcagaagatgcgattgactggggcgactttggggtagaggcagtgtctgaggggactgactctggcatctctgccgaggctgctggaatcgactggggcatcttcccggaatcagattcaaaggatcctggaggtgatgggatagactggggagacgatgctgttgctttgcagatcacagtgctggaagcaggaacccaggctccagaaggtgttgccaggggcccagatgccctgacactgcttgaatacactgagacccggaatcagttccttgatgagctcatggagcttgagatcttcttagcccagagagcagtggagttgagtgaggaggcagatgtcctgtctgtgagccagttccagctggctccagccatcctgcagggccagaccaaagagaagatggttaccatggtgtcagtgctggaggatctgattggcaagcttaccagtcttcagctgcaacacctgtttatgatcctggcctcaccaaggtatgtggaccgagtgactgaattcctccagcaaaagctgaagcagtcccagctgctggctttgaagaaagagctgatggtgcagaagcagcaggaggcacttgaggagcaggcggctctggagcctaagctggacctgctactggagaagaccaaggagctgcagaagctgattgaagctgacatctccaagaggtacagcgggcgccctgtgaacctgatgggaacctctctgtgacaccctccgtgttcttgcctgcccatcttctccgcttttgggatgaagatgatagccagggctgttgttttggggcccttcaaggcaaaagaccaggctgactggaagatggaaagccacaggaaggaagcggcacctgatggtgatcttggcactctccatgttctctacaagaagctgtggtgattggccctgtggtctatcaggcgaaaaccacagattctccttctagttagtatagcggacttaataaaagagg

SEQ ID NO: 5298 - DNA, 9138 bp, Homo sapiens
gtctctccaagggaatgaaaggtgaggggagcgtgagtgcaggcatgatgggaatctccgtgacttgtgaaccaaggactgggttttgctctggaagcctgtcctgattgcttctgtaatctggcgctatgcatccggatcttggacccttatgtacactgctgtatgttactcttacaattctgtgctcttctgtgagttcagacttggcaccttattttacttctgagccgctctctgctgtccagaaacttggtggacctgtagtactgcattgttctgctcaacctgtgaccactcgtatctcatggctgcataacggaaaaacattggatggaaacctggaacatgttaagattcatcaggggactctgacaattctttctctcaactcctctcttttgggttactaccagtgccttgccaacaatagcatcggtgccattgtgagtggccctgcgacagtatctgtggcagttcttggtgattttggttcatccacaaagcatgttattacagcagaagaaaaaagtgctggtttcattggctgcagggtaccggagagtaaccccaaagctgaggtgcgctataaaatccggggaaaatggctggaacattccacagagaattacttaatccttccatcaggaaatcttcagattttgaatgtatccttagaggacaagggatcatacaaatgtgcagcttataatcctgtcacacatcaattaaaagttgaacctattggccgaaagctccttgtgagtcgtccttcttcagatgatgttcacattcttcaccccacccattcacaggcattagctgttctttctcgtagccctgtaaccttggagtgtgtggtgagtggggtcccggctcctcaagtgtattggctaaaggacgggcaggacattgcaccaggaagcaactggagaaggttgtattctcatcttgccactgatagcgttgacccggcggactccggaaactattcctgcatggcgggaaacaagtctggagatgtaaaatatgtgacttacatggttaatgtacttgaacatgcttccatttctaaaggactacaggatcagatagtgtctctgggtgccacagtacactttacctgcgacgttcatgggaacccagcccccaactgtacctggtttcacaatgcacagcctattcatccttctgcacgacatctaactgcaggaaacggactgaaaatcagtggggttactgtggaagatgttgggatgtatcagtgtgtagcagataatgggattggatttatgcactctactggaagacttgaaattgaaaatgacggtggattcaagccagttataattacggcaccagtaagtgcaaaggttgcagacggagactttgttactctgtcctgcaatgccagtgggctgccggttccggtcattcgttggtatgacagccatggattgataaccagccatccatctcaagtcctgagatcgaaatcccgaaaatcacagttatcaagacctgagggcttgaacctggagcctgtgtacttcgtcctgtcccaagctggtgcaagctctctccatattcaggctgtgactcaggaacatgcggggaaatacatctgcgaagctgcaaatgaacatggtaccacacaggcagaagcatctctcatggttgttccttttgaaacaaatacaaaagcagagacagtcacacttcctgatgctgctcagaatgatgacagaagtaagagagatggttcagaaactgggttactgagctcatttccggtgaaggtccatcccagtgcagtggaatcagcaccagagaaaaacgccagcggcatctctgttcctgatgcccccatcatactgagccccccacagacccacacaccagacacgtacaacctggtgtggagggcaggcaaggatggtgggctgcccatcaatgcttactttgtgaagtatcgaaagctggatgatggggttggcatgctgggaagctggcacacggttcgagtcccaggaagtgaaaatgagctccatttagctgagctggagccatctagtctttatgaagtcttgatggtagcaagaagcgcagcaggtgaaggccaacctgccatgcttaccttccgaaccagcaaagaaaaaacagcgtcatcaaaaaacacccaggcatcctctccacccgtgggcatccctaagtatcccgttgtttcagaggctgcaaacaacaattttggagtggtacttacagattcctctaggcacagtggagttccagaggcaccagatcggcctaccatctccactgcatcagagacatcagtctatgtcacttggattcctcgggcaaacgggggttctccaatcactgccttcaaagtcgaatataaacggatgaggaccagcaattggctggtggcagctgaagacatccctccttccaaactttcagtggaagttcgtagtttagaaccaggttcaacatacaaatttagggtcattgccatcaaccattatggtgagagttttcggagttcagcatctcgtccttatcaagtggttgggttccccaatcgcttttccagccgtccaataactggacctcacattgcatacacagaggctgtcagcgatactcagatcatgctaaagtggacgtacattccatcaagtaacaataacactcccattcaaggattttatatctattaccgaccaacagatagtgacaatgacagtgattacaagagggatgttgtagaaggttcaaagcagtggcacatgattggccacctgcagccagaaacctcctatgacattaaaatgcaatgcttcaatgaaggaggagaaagtgaatttagcaatgtgatgatctgcgagactaaagtgaaacgtgttcctggagcttctgaatatcctgtcaaagacttgagtacccctccaaattctttgggaagtggaggaaatgtggggcctgcaaccagccctgccagaagcagtgacatgttatatctgatcgttggctgtgtgctgggcgtcatggtcctcattctgatggttttcattgcaatgtgcctgtggaagaatcgccagcagaataccatacaaaaatatgacccaccaggatatctctaccaaggatcagatatgaacgggcagatggtggactacaccactctctcaggagcaagtcagataaatggaaatgttcacggaggcttcctaaccaatggcggtctcagcagtggctattcccaccttcaccataaggtccccaatgcagtcaatggaattgtgaatgggagcctaaatggagggctttactccgggcacagcaactctctaaccaggacacacgtggattttgaacatcctcatcatctagtgaatggtggtggaatgtacacggccgtgcctcagattgaccctctggagtgtgttaactgccgaaattgtcgaaacaacaataggtgtttcaccaaaaccaacagcactttcagcagcagccctcctcctgtggtccctgtggtagcaccttatcctcaggatggtttggaaatgaagcccctcagtcacgtgaaggtgcctgtatgcctgacttccgcagtccctgattgtggccagttgccggaggagagcgtcaaggacaatgtggaaccagtccctactcagcgtacctgctgtcaggacattgtaaatgacgtcagctctgatggctcagaagatccagcagagttcagcagaggtcaggaaggcatgatcaaccttaggattccagatcatcttcagttagctaagagctgtgtatgggaaggagacagctgtgcccattcagaaacagagatcaacattgtaagttggaatgctcttattttgccacctgtccccgagggctgtgctgagaagacaatgtggtctccacctggcattcctttagacagcccgacagaggtccttcagcagccccgggaaacctgaggacatgcaaacaaccagtcatgttccaacttcaagccggtaactgcacacaacaggcctgggagcgaactgtgtgaaggaccttaattcaaatcagagaaaatcattatttatttttttgtagtagtaatgtcatatgaatgtatcttaaaacgtgtgcccttttatattatttatgccttaaatgttttcttccccattccttcctccccctcggtaggaaacaaccttgttttgcatagtattcagtcacctggagggcagaggggtccttccatgttttctaacagctatagtgacagcaagagctcctcatgcaaaggatcccatctcttggctgcttcggctaggagggaatgcaggggcccgttgaaggttgccaccagctgggttttcaggtggaaaatggtctttcaatagtgtattctcagacttttttttgtttgttttttgagatggagtcttgctgtcatccaggctggagtgcaatggctcgatcttggctcactgcaacctccgcctcccaggttcaagcaattctcccgcctcagcctcctgagtagctgggactacaggcacctgccaccacgtccagctaattgtcttgtatttttattagagacaaggtttcaggctggttttgaactcctgacctcaagtgatccacccgcctccgcctcccaaagtgcgaggattacaggcgtgagccaccacgtctggcctgtattatcagacttcctgagaacactttgaaatcaactgcagttgtgacccatgtttataataacagacctggctgacggattttacaagagtgccttccacagaagtggtaatgtgacctgttgactttgtatctgcacgtgggcacgagtgatgttcagtttgctaggcactagtcatagtgttatggacgtggtggagtgtaaggtcttgatgaattacggcagtatgcagaaaaggaaccaaggccagagagacaaataatgcctcatgtcccactgctttaaaattacattaatttataaaatggccactatgggctctttttgactgtttctcggagtaggaacaaaataagacattaaatggtggcttgaagagaaagatacacattttcagaagaaagaaaggggagggctgcagggagcctgtcttggcgggagctctccagtctgttggattagcacagggacacgcttatggtgccatgacgccgaaactagtcatcccccatctccagcataggcaacggcctgcaggggtgagtgtcagaaaagacttactttggaagaaaagggtttttttttgtttgtttgttttttgtttttttttgtttgtttgttttgggtttttttcctgaaatttcctgatacctttttcagaatgtcacccttgtaaataggcacctaaagccaagttggtcagcagagctcctgaccacggctgcctctgcgtgacaaggacatttgcagctgcctttggaaggctcttcacattaaaaaacaataattatgtaagtgtgtttcatagcttgagtcaagctttcaaggatcactgctcctttgtgcattgtgcatccctttggggaaagaaacagaaaattattctctttctatagagtcaagcaattccagcagaagtgaagaaatgttagtttcccagaaatcgcagtggaatagaatacaatactgtgttaaccaactttctgtataaatgcatcagtattcccttacatatgtctatatattttataatagaactgttagtgaaaatgtgcttgtttaagctgggtcactatgcaagagttacttccagtagaatgtagtgaatgtaattccctagtcggatattagggatgctgtagacccaagttctacattccagatgtccgtgcctatagtatactggatttattcttcatgttgcttaaatgcagttagctctggagggggatagctgcatcccttacttctgtgactagcaaaggacaaagtcccagcgcacagaatatgaaaacataccctgtgttagccaatcaagttacagcaatgctgtcacaaagggagttttagaaaactggggagtcattgtccgtagacagccattttgatttaggaaacaggtgtattagcatgagccttaggtcatgaactgcttttaaagattgagtttgaatatgggatctgtccacgaggaagagaaaatggctttacctttaggacaatctcattgtggactgctttatttatattattagtaacgctgttttaagtgttattctttttattgtattttatttataaaaaatgcctttatatattgaaatatataaatatatatatataaacacacacacacacacacacacacacatatatatatatatatataattgcctttatatttaggcggtatgagttctccctaagcgtgagttggctctgccctgcacaggcacccaaacagtcctacctaatgtcacttcaccaggaaatgagaggacatggtacagtgtgggagacagcactaacacgtgctgaataactactgtgtaccaggcactgtgctcggtgcttgttactgttaactcatttaacccccacaactcatctacaaagttggcattaaaatccccaagtcactcagtgagccatgggacctgaatccgaacctagtttatctggagccataatctgggctcctcccatttttccatactgctttccaaaagcattgtggttcactctttggatggaaccagtcccgttccgtatgctgtgatctatccctgccgtggaattcctccgaggctccaactccgcagccagagaagctgctctctggcctccgcgggcagagctctgcttatgacttcgtcttccagaggtccacatttctccccttgacgccccctgtctaccacctccacctggaaatttgatctttactgtgctcagtgatcacgaaattggtcaagcctattcatgttccttctcatctagaattctgtgtgattgttttagcataaactgccccgctcccactgtatcatttcacgatctccttttaatgtttttctttcagttttgcactgacagtctggtgacaggtgctgccagggtgcaagttacattgcaatgttctaaaccttttgaagtgttcttagcaaaagcctttctttctgggtgtttttgtcgaatgagtctatgaagactcaatgcatccatcttgggctgatcatgccacagatctcattccagctatagtactgccaagaagtgaagtttatcattgaattttacctgtgttgctctcttttaaagtaatgactttgagatgcatgctttgtatcatattgaaaagtatgttttattttccttaaagttgtaatattgtgtgtgaaactgtacatattttaaatgatgtagctttggcaggttttatttggttgatatgattttatattaaaagagaaggctgctttcatatagcatagcccctgaaggtgggaatactccctgtttgtacaacgctgcttatagtttgtgattggggtgggcgaatgtcttcctctgaaattctttggaaccccccacccctgtcctcccctgaaactcccctgtgcacacccctctgttctgactgcagagatcaaggccctgaaggagcaggatcttgggcaagtgttttaggggacgctgagaacatacctgaccctgggggcgatgtggaggcaggcccacctcctcggggcaactttgcgtttccttggagggaagggaggtgggtaggagaggagcttgggaggatgaggaggagcggtcccgcctcacacattgtctatttttaccattaaccgagcgccacatgtttatgaacttcaggatagaaatttagcctccttgtgaaaacgttttgttttactgccctaagaaaatacacatctctaggcttgtctgaccagaaagccagcaaagtcttttgcatcgggtgtggcccttttgtattttatttcccatatttaaataagccttccttaaaccctagccccagtcctgagagctttgagggtagccgaaaccccttatctaataaagtctaactctgtgagaaccacagaatcttcttaagcttctcaattttctgtctcctttcaggcgccacgtcccttgtgctggcgggtcccccgttggctttcttgccgtttcttctcatctgtgtctcctgcagaggcggctcggagtcccgagtcttctagtcagttgaacaagcattcatttgtgttttcacccagattacagacacacacacaaacagacacacacacttggagctagtgagtcatgctggcagctgacattgtgactctggaacagccccggtgctctgtgggccagctcccccagcctgggggcgggaagctacatctgcagtacctctgctccgtatcttgtgggctgcgactcctggagtcggaccactgcagcgtcagtgatgttcgtaagctatggttgagcaaaggaacacacacctacacaccttgcttcttcccactagccaaacctgggacccagccatcagcctgtctctgtgggagtcgcaatggaagtagccctctattggcgtgaacatcagctctgatttatttaggaattgctccatccacagactttttttctggaagcagctagcttgctcatacttctatagcaccacagatccttcccagtaccatggctttcacttgccctcagacacccagagatccctgtctccccattgtgggtcctcttccttgtcctgccacctctgtcttccacaaggtgggccagggcttctcttgtaaccatgtcacttagggacactgcagctgggccttgtaccagttgtgaagactgggtattaagtgaaagtggtagttggtgtcttagctacgttggttttatgaccaaagtctgacagaagggctcttcccaaatcccacctgccctccctaagcctatttgcatcttcctctttgggccttatggtgttgcagtcactgtgatggtgacattcactggagaatccgtggtttcttgtgcaggatccaaacctggggtggtggttggtgtttcaaggcctatgaagagcatatgtgggc

SEQ ID NO: 5299 - DNA, 4186 bp, Homo sapiens
gtctctccaagggaatgaaaggtgaggggagcgtgagtgcaggcatgatgggaatctccgtgacttgtgaaccaaggactgggttttgctctggaagcctgtcctgattgcttctgtaatctggcgctatgcatccggatcttggacccttatgtacactgctgtatgttactcttacaattctgtgctcttctgtgagttcagacttggcaccttattttacttctgagccgctctctgctgtccagaaacttggtggacctgtagtactgcattgttctgctcaacctgtgaccactcgtatctcatggctgcataacggaaaaacattggatggaaacctggaacatgttaagattcatcaggggactctgacaattctttctctcaactcctctcttttgggttactaccagtgccttgccaacaatagcatcggtgccattgtgagtggccctgcgacagtatctgtggcagttcttggtgattttggttcatccacaaagcatgttattacagcagaagaaaaaagtgctggtttcattggctgcagggtaccggagagtaaccccaaagctgaggtgcgctataaaatccggggaaaatggctggaacattccacagagaattacttaatccttccatcaggaaatcttcagattttgaatgtatccttagaggacaagggatcatacaaatgtgcagcttataatcctgtcacacatcaattaaaagttgaacctattggccgaaagctccttgtgagtcgtccttcttcagatgatgttcacattcttcaccccacccattcacaggcattagctgttctttctcgtagccctgtaaccttggagtgtgtggtgagtggggtcccggctcctcaagtgtattggctaaaggacgggcaggacattgcaccaggaagcaactggagaaggttgtattctcatcttgccactgatagcgttgacccggcggactccggaaactattcctgcatggcgggaaacaagtctggagatgtaaaatatgtgacttacatggttaatgtacttgaacatgcttccatttctaaaggactacaggatcagatagtgtctctgggtgccacagtacactttacctgcgacgttcatgggaacccagcccccaactgtacctggtttcacaatgcacagcctattcatccttctgcacgacatctaactgcaggaaacggactgaaaatcagtggggttactgtggaagatgttgggatgtatcagtgtgtagcagataatgggattggatttatgcactctactggaagacttgaaattgaaaatgacggtggattcaagccagttataattacggcaccagtaagtgcaaaggttgcagacggagactttgttactctgtcctgcaatgccagtgggctgccggttccggtcattcgttggtatgacagccatggattgataaccagccatccatctcaagtcctgagatcgaaatcccgaaaatcacagttatcaagacctgagggcttgaacctggagcctgtgtacttcgtcctgtcccaagctggtgcaagctctctccatattcaggctgtgactcaggaacatgcggggaaatacatctgcgaagctgcaaatgaacatggtaccacacaggcagaagcatctctcatggttgttccttttgaaacaaatacaaaagcagagacagtcacacttcctgatgctgctcagaatgatgacagaagtaagagagatggttcagaaactgggttactgagctcatttccggtgaaggtccatcccagtgcagtggaatcagcaccagagaaaaacgccagcggcatctctgttcctgatgcccccatcatactgagccccccacagacccacacaccagacacgtacaacctggtgtggagggcaggcaaggatggtgggctgcccatcaatgcttactttgtgaagtatcgaaagctggatgatggggttggcatgctgggaagctggcacacggttcgagtcccaggaagtgaaaatgagctccatttagctgagctggagccatctagtctttatgaagtcttgatggtagcaagaagcgcagcaggtgaaggccaacctgccatgcttaccttccgaaccagcaaagaaaaaacagcgtcatcaaaaaacacccaggcatcctctccacccgtgggcatccctaagtatcccgttgtttcagaggctgcaaacaacaattttggagtggtacttacagattcctctaggcacagtggagttccagaggcaccagatcggcctaccatctccactgcatcagagacatcagtctatgtcacttggattcctcgggcaaacgggggttctccaatcactgccttcaaagtcgaatataaacggatgaggaccagcaattggctggtggcagctgaagacatccctccttccaaactttcagtggaagttcgtagtttagaaccaggttcaacatacaaatttagggtcattgccatcaaccattatggtgagagttttcggagttcagcatctcgtccttatcaagtggttgggttccccaatcgcttttccagccgtccaataactggacctcacattgcatacacagaggctgtcagcgatactcagatcatgctaaagtggacgtacattccatcaagtaacaataacactcccattcaaggattttatatctattaccgaccaacagatagtgacaatgacagtgattacaagagggatgttgtagaaggttcaaagcagtggcacatgattggccacctgcagccagaaacctcctatgacattaaaatgcaatgcttcaatgaaggaggagaaagtgaatttagcaatgtgatgatctgcgagactaaagtgaaacgtgttcctggagcttctgaatatcctgtcaaagacttgagtacccctccaaattctttgggaagtggaggaaatgtggggcctgcaaccagccctgccagaagcagtgacatgttatatctgatcgttggctgtgtgctgggcgtcatggtcctcattctgatggttttcattgcaatgtgcctgtggaagaatcgccagcagaataccatacaaaaatatgacccaccaggatatctctaccaaggatcagatatgaacgggcagatggtggactacaccactctctcaggagcaagtcagataaatggaaatgttcacggaggcttcctaaccaatggcggtctcagcagtggctattcccaccttcaccataaggtccccaatgcagtcaatggaattgtgaatgggagcctaaatggagggctttactccgggcacagcaactctctaaccaggacacacgtggattttgaacatcctcatcatctagtgaatggtggtggaatgtacacggccgtgcctcagattgaccctctggagtgtgttaactgccgaaattgtcgaaacaacaataggtgtttcaccaaaaccaacagcactttcagcagcagccctcctcctgtggtccctgtggtagcaccttatcctcaggatggtttggaaatgaagcccctcagtcacgtgaaggtgcctgtatgcctgacttccgcagtccctgattgtggccagttgccggaggagagcgtcaaggacaatgtggaaccagtccctactcagcgtacctgctgtcaggacattgtaaatgacgtcagctctgatggctcagaagatccagcagagttcagcagaggagacagctgtgcccattcagaaacagagatcaacattgtaagttggaatgctcttattttgccacctgtccccgagggctgtgctgagaagacaatgtggtctccacctggcattcctttagacagcccgacagaggtccttcagcagccccgggaaacctgaggacatgcaaacaaccagtcatgttccaacttcaagccggtaactgcacacaacaggcctgggagcgaactgtgtgaaggaccttaattcaaatcagagaaaatcattatttatttttttgtagtagtaatgtcatatgaatgtatcttaaaacgtgtgcccttttatattatttatgccttaaatgttttcttccccattccttcctccccctcggtaggaaacaaccttgttttgcatagtattcagtcacctggagggca

SEQ ID NO: 5300 - DNA, 4461 bp, Homo sapiens
gcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagaaacagatattgatgacagatatggagatttggattccagaacagattctgatattccggaaattccaccatcctcagatagaacccctgagattctcaaaaaagctctatctggtttatcttcaaggtggaaaaactggtggatacgtggaattctcactctaactatgatctcgttgtttttcctgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttatatcatttgccctctatctggcaggtttctgcatgtttgtactgagtttggtgaagaaacattatcgtctgcagttttatatgttcgcatggactcatgtcactttactgataactgtcactcagtcacaccttgtcatccaaaatctgtttgaaggcatgatatggttccttgttccaatatcaagtgttatctgcaatgacataactgcttacctttttggatttttttttgggagaactccattaattaagttgtctcctaaaaagacttgggaaggattcattggtggtttcttttccacagttgtgtttggattcattgctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggaaagagtgagcttgtaccctttccagatccacagcattgcactgtcaacctttgcatctttaattggcccatttggaggcttctttgctagtggattcaaaagagccttcaaaatcaaggattttgcaaataccattcctggacatggtgggataatggacagatttgattgtcagtatttgatggcaacttttgtacatgtgtacatcacaagttttataaggggcccaaatcccagcaaagtgctacagcagttgttggtgcttcaacctgaacagcagttaaatatatataaaaccctgaagactcatctcattgagaaaggaatcctacaacccaccttgaaggtataactggatccagagagggaaggactgacaagaaggaattattcagaaaaacactgacagatgttttataaattgtacagaaaaatagttaaaaatgcaataggttgaagttttggagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcataatttaaaagactggtatttaaaagagtcaaacactataaaatgagtaagttgacgatgttttaagattgcacctggcagtgtgcctttttgcacaaatatttacttttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaagattgtctacttttcaaagaagtaaccatttgccaggggaaaacattctgcttttaggtagtttcaaaattcaggggagggagcctgaaatttttgccatgattggtttgttagaaagagcaggcatcagactacttctgataaaattgtttggaaggtcacgacctcgcaaaaacttttcaagagcaacaaggaagaattctgctgtgaagaacacagtgtacggatcctccgcatattatctcaacagaggacagtagctcaggaggcagcttcaaacggtgacctgtggcctgggccatctcttcgtcatgtgcttcacttttccctgtttccctgtgaactggcttccatggttctgtagggtagtgagtcggggttgtggctgcagcagagcaggagatgcttgcccgagtgggagcaacccacccccgtgtccccaatgcctcactcctggcttctagtgcagccctttgtagactcacctcgcaagaaggaagatctgcctggagacctgatcccagtccagctttttgaccataggtcatctttgtccccttgctcctttgcatcatgtcataaaatttgaggatatcagctgattattttttcttccaagaatgaaaatcaagcagaattgattcctacacgaaaaaaaagcacacgaatgccaaacctttcctttggtggactggacactaaccagatgagagtaaatttcttatccgtggacgtatgtaagctactgctgctgtgtgctctccacagccatatttattgtattaaacaatcagcactaaaccttcaaaaattgcccagtgttcctagttaaatgttcagaggggagaaatagatatattttaaataatgttttgctaatgaaaagagtaaatatttttgtttaaatcagcaaaaactttccattattttatatttccgtctactatacctaaaacaaaagattgccgttatacctgggttccactgatgcagtcagccagcacctcctcacatgcacacatgattagacataggtgcactcggtaccaagagtccattttatggtccagcatatactccattgattcatcatcactgcatgtgttcagccagtgtatctcacactatccatacaaatctaaaattgatactggaaatgttattataggaggcagtgatcgcatttaaaatcaggccacctacaagtttaattttcaacatctcatgtttttatttgtcccattacagcctcaaatgttggtcataaaaaaaatttaggctaccaaagtttaaagaataaaatgaaaattttataagaacttacattaaaaactcagtagtttgcatgagtaagaactccttgagatacacagatccccccacatttgtatttaaaataattggtgaggcattgaaatccagaattataagaaagcattactgaatatgtgtgttataaaatcaatattattataaacaaaataggaagctagaaatatttgggatcacagtaatagcttttctcaaatatacttttagaattgaatgtacattatcctatatgtaaaaaagcaaattattaattttaatggagctctcgattgacctttttagcatacttttatagcatgtatattaaaatagaatatattttagcaaaagattgccataaaaccctgacttggctcattttgatatttgcactgtgaagagggcttaaattccaatgtagcaatgtggtggcagacaaatgaaaaactaggaagttctttcacagtaatgcctagttgttccaaatttgctatatttggaggtgctctactggtacttcctgcttgactctctgacctgtgggatgcacattcttcctcagcgctttttccttgttgtggtgacgtacattcactatctgagagtgaaagaccacacacacccctctttttaaaattattgtatctcttccttttcactttggtttgaacaaagatagtgtcaccttgttccgtgaaaaagaaaaagcataaacagtgtatatttagggtatatgggtgatagcttatgatgtgtgtcaatcagttctctgaatcttttactgaaactgagacaggaaaataaaactgaaacaaatcatatttt

SEQ ID NO: 5301 - DNA, 1264 bp, Homo sapiens
cgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaaggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggt

SEQ ID NO: 5302 - DNA, 945 bp, Homo sapiens
ccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagc

SEQ ID NO: 5303 - DNA, 9298 bp, Homo sapiens
gaccgtgatggtggcgctgcgcgtgcgcactcgctccgagccctgctcccgggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaaggagtcagagtcagaagcaaaggtagatggagagactgcatcggacagtgagagccgggcagaatccgcacccctgccagtctctgcagatgataccccggaggtcctcaatagggccctttccaacttgtcttcaagatggaagaactggtgggtgagaggcatcctgactttggccatgattgcatttttcttcatcatcatttacctgggaccaatggttttgatgataatcgtgatgtgcgttcagattaagtgtttccatgagataatcactattggctacaacgtctaccactcatatgatctgccctggttcaggacgctcagctggtactttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctggaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataatgtgaccagtttaaatgtagtttgtattgtactgggggacctttcgttgttgttgtttgcttaaactgtgattttttttcccctccctaatttcaggggtgagattgactttgggaagacagattagttctttgtcaggccaacaagtgatggagtgcgggagagagaacttggcacccaaatatatcaaactattccgtgccgtggatgttttcattgccaacgagggtgtaatgatttgcttctgcaccttggtctagtgctggtttgtggtgtttttgtttgtaaattagcctcactgcctccctgaaagtgcacagtcagcccaggtctctagagtgtccagcagaggatggagccctcgggatgtttcagctcacacatccttgagtgacttcccatatgtgtgtggggctgaagcggcttctttccgctgaacttttatttccatttcagcctcgtggcttctcttattcaggtccaaggccccttaaaaacaaaacatattatcgcaagggctttcatttcagtattggctgtgtcactggcaggatgcatcactctccagggcctctttttcggagctactcccaattccactcttctgtgattctggctgagcaagttcatgccggtagaggctcattaagtgaggtcctgggcaccccccaaacaggaagtgttttcaggcccttacatgcttatccttaaggtgagtaggtatctcagcagcacacccgaacagtaaaggtgatcaataacgaaactgtagttttcagattgaagaatgaacctggatcaccaaactagataccgaaagggctcctcatttgtctcttttgtcccattgtgggcatatggtgggctccttgagaggagggagtctcagctggggcctggctgcagagacctgctcttgaatagggctgcctttgggatcagggagccgagcatactgggcaaggctcatcatgttcctttgtggaagtggttacttggtgggggtggggtggggaaggggggtctaggaagccgaagctgagtgcgcactagagctgctagcaggcaggccagagggtcagcttgtgttttattttctgatttctcctgcatgctttctggagatgaggattttttgtcaggtagctaggagagcactgccaccttgtgtccatatagcacaatgtttctctttcctattcacagacaagattcaagaaaccatttttacgtgtgtacattcaaatcttcatgaatggcatcacttgctttagacccattttttttttattggtcagaaataaaatgtgactgcaactgtgtgccctcccttgtcgtgaattccctgtttatcacttccatgcatggttttatgcttctcatttgtttatgtattcatgaatactgcatagtcctgattcagagacttttgctttgctttccaacttgtatccctacattctcacaacagccttcttacctcgggtgagagtcatgagcaccttaccaggcagggagcttccccaggatagtgtggtggagtcaggactcactccatcctgcactttacccacaggacacctggagggtcccccagccctgcttgcttttgtgaacgtcgtgtgagtacaccgaggtgttgcagctttccttccctctagctcaggaggcctggcctgagccaggttggagcttaaattgctgttggctcctgcctggtggaacaagggggtcatagaaaccagggctgatgggcaccccccagcccctgggagctctgctcatgaccgctcacagggtaccgagtctttgccttttgtgtgtgcgcatgctgccctcttaactgcttttagtattcagaaaggttccatttatgttttactcctgaaagtgaaaccctcttaggcaacttgtttcatattctgggcattttagtagctacagtattttgcatttaaaatgtaattactcttagtattgtacagccctataatgtatgagaactagtttcacatcctttgaaactaatctctttcattggggaggatacaacttttgactttacacaggtggactttgaatccatttttatagaatttttttccactgtaacttgacctatattatgcaagaaaatcccaaaaatatgttttaagggagactacacagaccttgtgatttggtctgagctagttgctgagttgactggagccttatttgaatggatctttgagttgagatcttcacactgtcagtgagcccttggctcagcccttgtcacctgtttgtatggggaccatgtttcccaaagctcaggttcatctccactattgacagagtcgggtagtgggagagtataagtgacttgagacagagtgtccttgctcagaaaactgtgaagcaggggtcttgttagttacaaagccagtcctagttgcatgtccaagggggtagattttcatcaccctactaaatgtggtatgtcactgctgaagccttttcctgttttagtaatatcttaggcactattgtcttttgtcttccagagtaacatatctgggcccacctttcttgcacactgtgattatgtgctaagaaaagggtggagttgggaggacaatttcacttgaacaggtttctgttcttctgaggtcagggtggggaggatgtccaggtgacttttatggacacattgcaagacagtaagccgcggatggactctcacttgtgctttggaacactggactccaaagagcaggtggaacaaactctggcctgaagatgatggctaatactcaggcagagccccgtattcttccctgacttggtcaaaacaaacttccttttcccttgatcaccctgcacgcagctgcccagcttccagtttttaaagagatgaacagctctcacttcctgactcagtttctcttgttgggtgggggccttgtgccacaacctgcatggggtgctagggtttaaaccaagtggtcacgaaggattcttatctcagggctctgcctggcccaccttctcttgggcctggactctccttatccacatccctgcagaaggtgggccctattctcagaagagtcctggctgctgttgccatctgaatgcgcccttccctttcaggttgaccagcagtggccttacctggcctctcaggtggatggaggctgttctcatctggggctgtctcttgattaaggctgtcacctgtttgtatagggaccatgtttcccaacgcactttgagtgcagtttaggaggtatcctttggatgctgaagtgttgggattttgaggacatgcggatgatttatgagaatagaggggcagagtttgtgaagtctagggttttttgtccagtgggtttcaaatttgttggctgtttaaagaccctgtctcctcccccaccctccccttccttttcccatcaaatgcctacctactgaggcgccttctctttttattcttgagccaatgagatatcagtgtgtttattaataaggattgcaatagtatagtgcttaatatgtgccaggcatagtgctaagggtttacatacgttatcccttttaatccagaaaacagcctttgattaggtattgttgtctccattttatagatgaggaaactgaggcagtatgactgaggccgagagcagtggttaagacagactttgggatcaaatcaccctaggtgcgggcaggtttctaggctgctctaagcttctaccttgaaggcagttgggtctgataatagtaccttcttcctggggtggttgtgaggatataacgaggtaatgcatgtaagcatttagtaccatgcctggcacatagtaagcactcaataaatggtagttacttttgttgagctcagctggtagtttgacctccgttggtgcaatgccagagatgggattgtcagccaccacactgccaccaccctgcacacagtctgggtccctccgagagaagcacgccaaccttaacatcccctacagcatcttggtgcttcacacaccatttaggaggccaccctaacgaggcaagaggacatgggggtgtgcagaagttctgttcttagtgagaatggctggcctgagaatccagctcacctcctctgcccacagtctggactgcttgtgggaaggccatctcctcctgtctggtggtacctccactctgggcagggagggcctgtctgtgactcgctctggaccccacttcccgctctggccaagggctgtcttctgtgcacatagctcaggagcctgcagcagttccctgtatgggtggatgtcctcaggggccaagaagagaagaatggggacaacagaaacctgctttgtaggggattatgtagactaaaagcctagaagttctgcccacatccttatgacgcagccaatctggagcttcatgtttccttctaaaagtagtaaccgggtagaagtgggtgacccattgaggacacatgatgtgaggtatttctgccggattctaggttagcaaagactcaaatgggtgactcatgaatgaagggagaacaggcacaggacttaatgaaaagagtttcttgaacttagttttctgaatgggggtggggagttggggcacgtgtgtgtaaggggaggctgcctcactttgaaggaatggtgttggctaacaggatccatgaaattcctaggtcagttgaataataactgaactactggtttgactgtggattatttcctgggtattagtgggacccaacagcacattgctattaatagtatggaaataatggtccctctgtttcattgaattgctgaagtaatgataatgccatgaaccaggagaagatggttgtgggggtttctaggaagcagctgctgtgacaggccaatcccaggcttgcccccgagccctcctgtccttctgggtttgtgtttgccttgcctggtgcttcctccctcattgtgttgttgaatagacctaggcagccttgtatccatagaaagcctccactgctgggccggggagggggttgtggtaagggccctctggaaatcaagcagagaatgcctttgcagtggtctcccgggcattgggcagggcctagccttttgcagcccccagaggaccttgcctgcataaagcactcagaagggttagccacctggtgattttgtctctagtgaaactgtgtttgccgataatcatccacatagccacctctgtcctcgcagtttggatgcctttttttgacacctgcgctaggttcttgtatgctggcttttcttaaaggaacagcagagtagaaaagaggttgagaatgttttctagcaggcagaatgtgcatacatgttttcatgagtgtcctttgggtgctgtttcttttaaatcctctgtgcacagggctctggcctttagtaaactgtttttctgtcttacgtcatgctgactgggtgctaggggctgattacaaaggggaagagttgaacagacatcaggggccgatgaaaccaaaggactaggagtcaggagaacaagtcagggattaggagacagcggtttggtttattgttatccagctggaggactcctaggggcagcagcaggaggaataccagggccacggaggggccaggagtctcacagtggagggcagactctaacagatgccagctgaacgctcgctggccctggatgtcatacgagttggggaccagaaatctgggctcagagaacccgtccagggagatttgaagccatgggttatcttctagagttgatactgataatatattttaatttttattgatgtttaataccttctgaaacaggagggtaagatcagatgggaagcccctctgttgaaggatcttgggaaccttggtggttttttttttttttttggttttttttttttgatcgagctgtggacatccttcttaattcgattctgaggatttgtttaactaaaaagttcccaaacacagaaagggcctccccacctgctttggggagctgtctgtgctgggagtgccaggcatcccatgggacccatcactgccagtgtctgtgcctcccagaggtcagccgtgtctgccctggctctgtctcctctgtgacagggcagagcatttctggtcagtttctccatggtgcctcccacccctttgtaaagtggatggacatgatggaattcagttgtctcaccctgatagcctgggtgttgatattcactttacccgcactcagacacaggcgaccttgaagcagttctcggtgtgtagagtccacgtgacagtccccacagcctccccagatagctgtgtgcctgtgcgctactgctgtgccattttcccaacttggcgtttcactaaatgcagctgatctctctctctgtgcactcgtgatccatgttgaacaatacatgtaggttctttttccacgcaatgtaagaacatgatatactgtacgttggaaagcatttaccttatttatatacctgaatgttcctactacacaaataaacatatattaaattcta

SEQ ID NO: 5304 - DNA, 914 bp, Homo sapiens
ttctcctgtgtgtaaactatttcttctatggtgagacagtgacggattacttcttcaccctggtccagagagaagagcctttgcggattctcagtaaataccaccggttcatttcctttactctctatctaataggattctgcatgtttgtactgagtctggtcaagaagcattatcgactgcagttctacatgtttggctggacccatgtgacattgctgattgttgtaacacagtcacatcttgttatccacaacctatttgaaggaatgatctggttcattgtccccatatcttgtgtgatctgtaatgacatcatggcctatatgtttggctttttctttggtcggaccccactcatcaagctgtccccgaagaagacctgggaaggcttcattgggggcttctttgctactgtggtgtttggccttctgaaaacggtccggatgtaccccttccagattcacagcatcgctctctccacctttgcctcgctcattggcccctttggaggattcttcgcaagtggattcaaacgagcctttaaaatcaaagactttgccaataccattcctggccatggaggcatcatggatcgctttgactgccagtatctgatggccacctttgtcaatgtatacatcgccagttttatcagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtctttttttttttttttt

SEQ ID NO: 5305 - DNA, 8013 bp, Homo sapiens
agggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataatgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttatagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctgctcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacagagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggttccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgatttgtacatgccattgaaaattattaatcagaagaaaattaagcagggtctttgctatacaaaagtgttttccactaattttgcatgcgtatttataagaaaaatgtgaatttggtggttttattctatcggtataaaggcattgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgt

SEQ ID NO: 5306 - DNA, 5235 bp, Homo sapiens
caggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataatgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattg

SEQ ID NO: 5307 - DNA, 543 bp, Homo sapiens
tcggacagctcggggtcagtcgacggagcacaccgggcgcccgaatccgccgggtcccactcacgcccgccggccgccggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacga

SEQ ID NO: 5308 - DNA, 572 bp, Homo sapiens
agaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaac

SEQ ID NO: 5309 - DNA, 723 bp, Homo sapiens
gagccacagtgtctcagccaggggcagggccggggaactcctgcgaaaaaccacgggccggaggagcagcagccgcgcgggcccagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatac

SEQ ID NO: 5310 - DNA, 1104 bp, Homo sapiens
agtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggaaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactgg

SEQ ID NO: 5311 - DNA, 594 bp, Homo sapiens
agaaagggaagaaggcaaacaggaaaagagccagaagagcagagttcccagcagaggggaagcaagtggagaggcggtgtggaggaatcaatttggccccatctggaatggacagaaggctagaacctgcagtgcagtgagtgtgggagaaaccagctggcacaaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattcc

SEQ ID NO: 5312 - DNA, 1649 bp, Homo sapiens
agtgcattgtgggaaactcccgagctctcctccgcgttcgcagccgccgtcatcccgcggaggagcgcgcagccccggggaggccggaggacgcgcccatagaatgcccaggggcgacaaactgtcctgagcccctctggtgcagccacctgcctgtcccatacgccccgcccaccatggagtccagagggaagtcagccagcagccccaagcccgacaccaaggtgccccaggtcaccaccgaggccaaggtacccccggcagccgatgggaaagcccccttgaccaagccctcgaagaaggaggccccggccgagaagcagcagccgccagcagcccccaccacggcacctgccaagaagacctcggccaaggccgaccctgcccttctcaacaaccacagcaacctgaagccagcccccacggtccccagcagtcccgatgcaaccccggagcccaagggtcctggggacggggcggaggaagatgaggctgccagtggggggcctgggggccgaggtccctggtcctgtgagaacttcaaccccctgctggtggctgggggtgtggccgtggcagccatagccctgattctcggtgtggccttcctggtccggaaaaaataatacctgggggccaggcggggggcacggagccacttcctgtacagacccgaggaagccagtgcatgcagagttcacccttacctattcgtacacacgcacattcattacacacctacatacgcccccaacacacgcgcacggtgaagaggacgcccgagcccacccctgctgacccaggacttccccaacctccagggcagaaagagcccaggctccggggtccacagcacaggatgtggggcgagggcacagctggggaacggcaagaaaggaatggaccctgtgtgtggccccccccacccctggcggctgggtgatcctgggcccccagggctggtctgagtgcaggtgggggtgccgggatgggttgggcctgggcccggccctcgtggggacattaaagggcgcggtggctccactcgccccatttctgctctttgcgtaccccccgggggtctgcctgggcgaatgcagtgggacggacctggggtgggcactcacctcagcagagcctcaatgccacctccccacaccacccaagcctagctgggtgggaagacggagccctgaagcctgcgtgtggagggggtgctgcccaagggtcgccttccccagcttgtgctccaggggagccccgacgccggcggggaggcagggatgtcgagggcccctcacagctgtgcccgccctgccccgctagactgcccctccagcttgcacccagcaccacctgagtctaaccagcgtataatgcaataacaggtagagtagaactgcttttggcggcgaccgtcacacactgtcctcagcccactgcacctggggaagcccctcgtgcagcccctccttagcacatccagtcccagcgtggcccttggcgcgcagcagcaggcgaactcccagaaggtggtggtgggcactgtgagaacgtggcctgccctcactggccagtggccacaggaaccccgggcctgagtggaggctgagtctgaaataaactctgtcgtctgaaggctgctcttg

SEQ ID NO: 5313 - DNA, 2730 bp, Homo sapiens
ctctgggcggtggggtgggcggtgggttggggggtttcgttgtgcgcgcaaagccgcgcggggctgagggtcttgttctgccggcgcctgtccggacccgggcccctctccgctttcggccggcctcgggcaccgggcttctggagctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaacacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaa

SEQ ID NO: 5314 - DNA, 1079 bp, Homo sapiens
atgattggctggagtggcccgagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatagcaagaaagcctattttctgtatatgtattccagatatctggtgagggccattttaaaatgtcattctgcctttagtgaaacatccatatttagaaccaatggaaaagttaaatcttttaaatagcttagcagtgggccactgaatgaatgtactttatacatagcaataataaaaaaaagatatcataaataaagttaaaaaggatggtagagaagaaaatattcttaggaatgactaacaggataagtaacaacctgattatttatttactttaggttatataaggttcttcatgcctgtgaattaatattattgtgtaagaattaagttaaaaagcctgggctgacttttaaatttataaattcatttatcatgtttatagtatatttattgtttttctttcatggctattaaaaagtatgactgtaaaggacaatgcaagtaaaccaacttaatactgtattgaataataagtacaatttattattttactttgaaacattatgaatttactttcctactttttcttagttgttatctatataaattgattaaaaaaacattttatgtacttctcatttcctagtacaggttgagtatcccttatttgaagtgcttgggaccaaaagtgtttcagatttcagatttttttcagattttggtatatttgcattatacttactggttgaaataaaaaatgctgcagtgagtgtca

SEQ ID NO: 5315 - DNA, 3153 bp, Homo sapiens
atgattggctggagtggcccgagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatagcaagaaagcctattttctgtatatgtattccagatatctgtctggagaaaaaaagaaggacgatgaaacagttgatagcttaggccccctggaaaaaggacaagtgaaaaatgaggcgcttagagaattgagagtggagctcagcaaaaaacaccaagctcgagaacttgatggatttggactttatctgtatggtgtggtgcttcgaaaactggacttggttaaagaggccattgatgtgtttgtggaagctactcatgttttgcccttgcattggggagcctggttagaactctgtaacctgatcacagacaaagagatgctgaagttcctgtctttgccagacacctggatgaaagagttttttctggctcatatatacacagagttgcagttgatagaggaggccctgcaaaagtatcagaatctcattgatgtgggcttctctaagagctcgtatattgtttcccaaattgcagttgcctatcacaatatcagagatattgacaaagccctctccatttttaatgagctaaggaaacaagacccttacaggattgaaaatatggacacattctccaaccttctttatgtcaggagcatgaaatcggagttgagttatctggctcataacctctgtgagattgataaatatcgtgtagaaacgtgctgtgtaattggcaattattacagtttacgttctcagcatgagaaagcagccttatatttccagagagccctgaaattaaatcctcggtatcttggtgcctggacactaatgggacatgagtacatggagatgaagaacacgtctgctgctatccaggcttatagacatgccattgaggtcaacaaacgggactacagagcttggtatggcctcgggcagacctatgaaatccttaagatgccattttactgcctttattattatagacgggcccaccagcttcgacccaatgattctcgcatgctggttgctttaggagaatgttacgagaaactcaatcaactagtggaagccaaaaagtgttattggagagcttacgccgtgggagatgtggagaaaatggctctggtgaaactggcaaagcttcatgaacagttgactgagtcagaacaggctgcccagtgttacatcaaatatatccaagatatctattcctgtggggaaatagtagaacacttggaggaaagcactgcctttcgctatctggcccagtactattttaagtgcaaactgtgggatgaagcttcaacttgtgcacaaaagtgttgtgcatttaatgatacccgggaagaaggtaaggccttactccggcaaatcctacagcttcggaaccaaggcgagactcctaccaccgaggtgcctgctccctttttcctacctgcttcactctctgctaacaatacccccacacgcagagtttctccactcaacttgtcttctgtcacgccatagttggctactctcaagccagcacattgttagacccatcttaattaagccttacctccatgtaaagaacagcacgtctgttccaaggacctcagctcttcttgtttctacagatggcaacagctccatagggacagcttgtataattaccttcagaggccaactgacagaatcctggcaggaacagacattatcttgccagttagaagtacttctgtctcacttatgtccaaagagtggctatagatcttggccttcttccctgaatgctttttttttttggcccccaagaaagtcccttttatagcactttagcacaggcaatgctacaggaacaaagtttcaatgctgctgagagtgaaagaaaggaggaaagtctgccactctaccctgagctggcagtagggcactgagtaccctaggaagaagtcagagcaatggatacaaatgaccttgctcttggatttgctgagcatgatccctattctgatgtcagagattaggtttaaatggaatagagctatccatttgttcttactctctagggagacaatcttccaaaacagttttgggggggtcttctaaagctttcaaattggaagtaactttattcaactagagttgaataaaagaagggcaaaaataatctcacagagcttggaactgctgatagcccttactgagggcaaaagatggctatattgttagctatactcctaccaaagcaagcaaggagataggattatagataatttcacggacatttggaaataacattggtgattatacagacaagaataaactcacttcaagctggtctgttttaataaattttcaacgtaattgtctatttttttccctcccatctgcaacagaatacatttttttcagcctttatctagatgaggtaaagggaatcattcttatggtgctcttggagagtttcaggcctgtgcatgtgtgtacagcaggaggtaatatgctataatgtctgctgtaatatatttgcacagtagatgctatggatcattctgagctcagggtccagactttattcttattcccagaattttgtgttacgtttttacctcctaacatatgacacttcatcttatattaaggaaggtttagaatatctaatacgacttgaattcatttgttactaagccttctcaggcaagctgtatactagttactggtctccactgccatgccttttcaaggttcccatggtccagaatgatgtttgattcttaatttttctgtcccttttataatttgttttaatgattttgctacatttggaattcaataaaaaatgtgaacaataa

SEQ ID NO: 5316 - DNA, 3783 bp, Homo sapiens
gtcggcttggttttctgctacccggagctgggcaagcgggtgggagaacagcgaagacagcgtgagcctgggccgttgcctcgaggctctcgcccggcttctcttgccgacccgccacgtttgtttggatttaatcttcaggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaatgaagcctttgagtttaagaagccagtaagacctgtatctcgtggctgcctgcactctcatggactccaggagggtaaagatctcttcacacagaggcagaactctgccccagctcggatgctttcctcaaatgaaagagatagcagtgaaccagggaatttcattcctctttttacaccccagtcacctgtgacagccactttgtctgatgaggatgatggcttcgtggaccttctcgatggagagaatctgaagaatgaggaggagaccccctcgtgcatggcaagcctctggacagctcctctcgtcatgagaactacaaaccttgacaaccgatgcaagctgtttgactccccttccctgtgtagctccagcactcggtcagtgttgaagagaccagaacgatctcaagaggagtctccacctggaagtacaaagaggaggaagagcatgtctggggccagccccaaagagtcaactaatccagagaaggcccatgagactcttcatcagtctttatccctggcatcttcccccaaaggaaccattgagaacattttggacaatgacccaagggaccttataggagacttctccaagggttatctctttcatacagttgctgggaaacatcaggatttaaaatacatctctccagaaattatggcatctgttttgaatggcaagtttgccaacctcattaaagagtttgttatcatcgactgtcgatacccatatgaatacgagggaggccacatcaagggtgcagtgaacttgcacatggaagaagaggttgaagacttcttattgaagaagcccattgtacctactgatggcaagcgtgtcattgttgtgtttcactgcgagttttcttctgagagaggtccccgcatgtgccggtatgtgagagagagagatcgcctgggtaatgaataccccaaactccactaccctgagctgtatgtcctgaaggggggatacaaggagttctttatgaaatgccagtcttactgtgagccccctagctaccggcccatgcaccacgaggactttaaagaagacctgaagaagttccgcaccaagagccggacctgggcaggggagaagagcaagagggagatgtacagtcgtctgaagaagctctgagggcggcaggaccagccagcagcagcccaagcttccctccatccccctttaccctctttgctgcagagaaacttaagcaaaggggacagctgtgtgacatttggagagggggcctgggacttccatgccttaaacctacctcccacactcccaaggttggagcccagggcatcttgctggctacgcctcttctgtccctgttagacgtcctccgtccatatcagaactgtgccacaatgcagttctgagcaccgtgtcaagctgctctgagccacagtgggatgaaccagccggggccttatcgggctccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccatgctctctgcctagttcttgatggatttaagga

SEQ ID NO: 5317 - DNA, 3663 bp, Homo sapiens
gtcggcttggttttctgctacccggagctgggcaagcgggtgggagaacagcgaagacagcgtgagcctgggccgttgcctcgaggctctcgcccggcttctcttgccgacccgccacgtttgtttggatttaatcttcaggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaatctttcctcaaatgaaagagatagcagtgaaccagggaatttcattcctctttttacaccccagtcacctgtgacagccactttgtctgatgaggatgatggcttcgtggaccttctcgatggagagaatctgaagaatgaggaggagaccccctcgtgcatggcaagcctctggacagctcctctcgtcatgagaactacaaaccttgacaaccgatgcaagctgtttgactccccttccctgtgtagctccagcactcggtcagtgttgaagagaccagaacgatctcaagaggagtctccacctggaagtacaaagaggaggaagagcatgtctggggccagccccaaagagtcaactaatccagagaaggcccatgagactcttcatcagtctttatccctggcatcttcccccaaaggaaccattgagaacattttggacaatgacccaagggaccttataggagacttctccaagggttatctctttcatacagttgctgggaaacatcaggatttaaaatacatctctccagaaattatggcatctgttttgaatggcaagtttgccaacctcattaaagagtttgttatcatcgactgtcgatacccatatgaatacgagggaggccacatcaagggtgcagtgaacttgcacatggaagaagaggttgaagacttcttattgaagaagcccattgtacctactgatggcaagcgtgtcattgttgtgtttcactgcgagttttcttctgagagaggtccccgcatgtgccggtatgtgagagagagagatcgcctgggtaatgaataccccaaactccactaccctgagctgtatgtcctgaaggggggatacaaggagttctttatgaaatgccagtcttactgtgagccccctagctaccggcccatgcaccacgaggactttaaagaagacctgaagaagttccgcaccaagagccggacctgggcaggggagaagagcaagagggagatgtacagtcgtctgaagaagctctgagggcggcaggaccagccagcagcagcccaagcttccctccatccccctttaccctctttgctgcagagaaacttaagcaaaggggacagctgtgtgacatttggagagggggcctgggacttccatgccttaaacctacctcccacactcccaaggttggagcccagggcatcttgctggctacgcctcttctgtccctgttagacgtcctccgtccatatcagaactgtgccacaatgcagttctgagcaccgtgtcaagctgctctgagccacagtgggatgaaccagccggggccttatcgggctccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccatgctctctgcctagttcttgatggatttaagga

SEQ ID NO: 5318 - DNA, 730 bp, Homo sapiens
ccgcgaaaggccggcctggctgcgacagcctgggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcagtgattatgagcaaccactggaggtgaagaacaacagtaatctgcagagaatgggctcctccgagtcaacagattcaggtttctgtctagattctcctgggccattggacagtaaagaaaaccttgaaaatcctatgagaagaatacattccctacctcagaagctgttgggatgtagtccagctctgaagaggagccattctgattctcttgaccatgacatctttcagctcatcgacccagatgagaacaaggaaaat

SEQ ID NO: 5319 - DNA, 3594 bp, Homo sapiens
gcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 5320 - DNA, 1978 bp, Homo sapiens
acccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggca

SEQ ID NO: 5321 - DNA, 2291 bp, Homo sapiens
gacccggcagcgacgcgggcggggacgcggtgcatcgctactgcgcccggcggacagcgacttgctgctcaaaaagaataagaaccagggtttttgtttgttttttttttttttaattaaggtaaaaataacgcacttttttttttgcggaacctgaaaaattcaagaagttgaaaaacgcttttcacgtcacctggagagatgcacagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacc

SEQ ID NO: 5322 - DNA, 1756 bp, Homo sapiens
gctactgcgcccggcggacagcgacttgctgctcaaaaagaataagaaccagggtttttgtttgttttttttttttttaattaaggtaaaaataacgcacttttttttttgcggaacctgaaaaattcaagaagttgaaaaacgcttttcacgtcacctggagagatgcacagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtg

SEQ ID NO: 5323 - DNA, 3096 bp, Homo sapiens
ggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 5324 - DNA, 5801 bp, Homo sapiens
tcgctggtgagtttaaatgagcaggggctggccgggccggagccgctacagggggggcctgaggcactgcagaaagtgggcctgagcctcgaggatgacggtgctgcaggaacccgtccaggctgctatatggcaagcactaaaccactatgcttaccgagatgcggttttcctcgcagaacgcctttatgcagaagtacactcagaagaagccttgtttttactggcaacctgttattaccgctcaggaaaggcatataaagcatatagactcttgaaaggacacagttgtactacaccgcaatgcaaatacctgcttgcaaaatgttgtgttgatctcagcaagcttgcagaaggggaacaaatcttatctggtggagtgtttaataagcagaaaagccatgatgatattgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaagttttgggattttgccattagaaaccccaagtcctggagatggatcctatttacaaaactacactaatacacctcctgtaattgatgtgccatccaccggagccccttcaaaaaagtctgttgccagaatcggccaaactggaacaaagtctgtcttctcacagagtggaaatagccgagaggtaactccaattcttgcacaaacacaaagttctggtccacaaacaagtacaacacctcaggtattgagccccactattacatctcccccaaacgcactgcctcgaagaagttcacgactctttactagtgacagctccacaaccaaggagaatagcaaaaaattaaaaatgaagtttccacctaaaatcccaaacagaaaaacaaaaagtaaaactaataaaggaggaataactcaacctaacataaatgatagcctggaaattacaaaattggactcttccatcatttcagaagggaaaatatccacaatcacacctcagattcaggcctttaatctacaaaaagcagcagcagaaggtttgatgagccttcttcgtgaaatggggaaaggttatttagctttgtgttcatacaactgcaaagaagctataaatattttgagccatctaccttctcaccactacaatactggttgggtactgtgccaaattggaagggcctattttgaactttcagagtacatgcaagctgaaagaatattctcagaggttagaaggattgagaattatagagttgaaggcatggagatctactctacaacactttggcatcttcaaaaagatgttgctctttcagttctgtcaaaagacttaacagacatggataaaaattcgccagaggcctggtgtgctgcagggaactgtttcagtctgcaacgggaacatgatattgcaattaaattcttccagagagctatccaagttgatccaaattacgcttatgcctatactctattagggcatgagtttgtcttaactgaagaattggacaaagcattagcttgttttcgaaatgctatcagagtcaatcctagacattataatgcatggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaaggaagagttatgctttatcttgaaggaaccattagatatggaaaatagtgatgaaccagagtttcttggttgctttttcaaaaatttgtttttatttggttctgttcctgataaacagagtaactgaccttcatttctaggttcttcaagaatggtgtttgcaagtgccagatggaacaataaaagacgttgcctataacagtgacttgattgccaaggaatgtaaattaccttaaacttgcagtatctcccataaacaaatgtaatgggcatattgggactcgtatgtaggaatcaaatatccctccatacagtgtactcttattcttggcaagaatgctttaatgtctaaccaagaattttaatttattcatcttgcttcaaagtgttgatcattgttgtcttggtattgcaaactttaaaattgtttcttaccatattgcctcttctctttgagctctgtgggatcacctttaacattcagagatgatagagtggttccccactgagaagccaaaacaaggcccttaataaccccttaagttcaccatatgaatcagaaggagaacactaaagtggagagacttttaagagatcatgatagtgaaagccttaatataatcagaattgtaccataaccttgaatctatatttgttcaaaacatccctttgacttttctaagtgtttgcttaagcagagtgtaagaatgtgtggttacctttggttgagatcctttccattctttttgactctctgcttcagattttttcagtagtgtgagtcaccaaaacatttactaagagtaattgggtttaggatgttggaaatttttagcttgggggaaaaaacattcttatgaaggagataggttctcttctgagtttgtcataatatagattggtgtctttggaaaatggccacaattttaagaattcaattatgcatataaaatgataattattggaattccacagtaacagatttaaacagtcttaaattgtttatctcctttactgtaatgtattgaaatttttagagaaattttagttgttaacattttattaagtgccagtgtcagaatataacaaattatagtttcttatgaatgacaggcctacagttattattctggattatttgatggaggacaaacttacctgtatttgttagtcaagctgtgaaaataaggtggattacaaaagatgtgaaaaaaattttagtctgtagactcagtaattttctataatttactgttaatctcatttgaacatggattaggtacaatttataaattaattcaagtcagggtctttaggtatcaggtgccagagagatatttaacagatttccctacctaaatttatgtatatgtactgtctaaaacaatacttttttaaaaaaaaggaacagttgggagaaaataaatataatgaaaaattcccagaggctagcacttggattctaacacgtatgctattgtattatccattagttctgtaatatttaattttagattcttttatttttttaattggcaaagcacaaggtgctgtataacagtgtcatttagagttttatagaaagcttcaacctgagttctgcgttataaagcctggagaaagctaagcttagaacataacttgctgaagtataattatctttttgtagcaggaatttatgtgccagaggtgagagtctttctggtactgattttttgagaccaaggataaaaggatcgttttgtaagacatgccatggcaatggctggttgggggacagtttccgcccaagcttggcctattttatttttcctcatacctactttcaaagtcatttaggtatttgaagccttatttcccacgtagtaacactttctggcttttgcagtttctttttttgtttggttttgttttttgcatggaatggggatcaaacaacccgaagaagaacacattttgatcaagcaaaatgtttgcttcaaatttcagaagtttattttacagaaattaaattaagtagtttgacatccttttctctgtttcacacatatattaggttggtgcataagtaattgtggtttttgccatgacttttatggcaaaacctgcaattacttttgcaccaacttaatacatctatatacatatatatatacgcgcacacacttgttcagaagttatgttgtggccttggatttgtttttccccttggaaatggttcttaactctgggattttagaaggttagaatattttttcaagagaacagtggtactcaaaagaatgaaaggtggtccctacattttctgtattcatcacttaaaatttttaatttttccgagaactacaagtaacatttgaaccatgctgctgttgtaccttaaacaaaaactcagtgataaccagtatttagtctattaaaaatgctctttttgaagaaaaaagtttggaagtctctgattagccagagtatagtatgagtcttcactgagaaatatggtgacccattttctttgtgaaaacctgggaaaatgcaagtgtgggtatgaagtgtgtgttctgtttgcattgaaacaatgtaattttgtgtcttctttttgctttaactgacttatttcagaaattgtacagtgttgagggggaaagtcttttctgttaatatatttgcaattcattaaaggatatggaaaatccaaataagttacttttgaaagcaatttataatcaagttgttaaagctatatgaaagctgtgccatctgtattttaataagaaggcacagaaaaacagagatacagttttatgtttcacaaaaaactagagcaatgtttatctaattttttaaaacttacactcttaatatatttatatttttaaacggtcatactcttttttagtattatttggaatatcaaaataaatactatgacaaaaacaa

SEQ ID NO: 5325 - DNA, 2570 bp, Homo sapiens
aatgagcaggggctggccgggccggagccgctacagggggggcctgaggcactgcagaaagtgggcctgagcctcgaggatgacggtgctgcaggaacccgtccaggctgctatatggcaagcactaaaccactatgcttaccgagatgcggttttcctcgcagaacgcctttatgcagaaggcttgcagaaggggaacaaatcttatctggtggagtgtttaataagcagaaaagccatgatgatattgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaagttttgggattttgccattagaaaccccaagtcctggagatggatcctatttacaaaactacactaatacacctcctgtaattgatgtgccatccaccggagccccttcaaaaaagtctgttgccagaatcggccaaactggaacaaagtctgtcttctcacagagtggaaatagccgagaggtaactccaattcttgcacaaacacaaagttctggtccacaaacaagtacaacacctcaggtattgagccccactattacatctcccccaaacgcactgcctcgaagaagttcacgactctttactagtgacagctccacaaccaaggagaatagcaaaaaattaaaaatgaagtttccacctaaaatcccaaacagaaaaacaaaaagtaaaactaataaaggaggaataactcaacctaacataaatgatagcctggaaattacaaaattggactcttccatcatttcagaagggaaaatatccacaatcacacctcagattcaggcctttaatctacaaaaagcagcagcagaaggtttgatgagccttcttcgtgaaatggggaaaggttatttagctttgtgttcatacaactgcaaagaagctataaatattttgagccatctaccttctcaccactacaatactggttgggtactgtgccaaattggaagggcctattttgaactttcagagtacatgcaagctgaaagaatattctcagaggttagaaggattgagaattatagagttgaaggcatggagatctactctacaacactttggcatcttcaaaaagatgttgctctttcagttctgtcaaaagacttaacagacatggataaaaattcgccagaggcctggtgtgctgcagggaactgtttcagtctgcaacgggaacatgatattgcaattaaattcttccagagagctatccaagttgatccaaattacgcttatgcctatactctattagggcatgagtttgtcttaactgaagaattggacaaagcattagcttgttttcgaaatgctatcagagtcaatcctagacattataatgcatggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaa

SEQ ID NO: 5326 - DNA, 2579 bp, Homo sapiens
ccgctacagggggggcctgaggcactgcagaaagtgggcctgagcctcgaggatgacggtgctgcaggaacccgtccaggctgctatatggcaagcactaaaccactatgcttaccgagatgcggttttcctcgcagaacgcctttatgcagaagtacactcagaagaagccttgtttttactggcaacctgttattaccgctcaggaaaggcatataaagcatatagactcttgaaaggacacagttgtactacaccgcaatgcaaatacctgcttgcaaaatgttgtgttgatctcagcaagcttgcagaaggggaacaaatcttatctggtggagtgtttaataagcagaaaagccatgatgatattgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaagttttgggattttgccattagaaaccccaagtcctggagatggatcctatttacaaaactacactaatacacctcctgtaattgatgtgccatccaccggagccccttcaaaaaagtctgttgccagaatcggccaaactggaacaaagtctgtcttctcacagagtggaaatagccgagaggtaactccaattcttgcacaaacacaaagttctggtccacaaacaagtacaacacctcaggtattgagccccactattacatctcccccaaacgcactgcctcgaagaagttcacgactctttactagtgacagctccacaaccaaggagaatagcaaaaaattaaaaatgaagtttccacctaaaatcccaaacagaaaaacaaaaagtaaaactaataaaggaggaataactcaacctaacataaatgatagcctggaaattacaaaattggactcttccatcatttcagaagggaaaatatccacaatcacacctcagattcaggcctttaatctacaaaaagcagcagcaggtttgatgagccttcttcgtgaaatggggaaaggttatttagctttgtgttcatacaactgcaaagaagctataaatattttgagccatctaccttctcaccactacaatactggttgggtactgtgccaaattggaagggcctattttgaactttcagagtacatgcaagctgaaagaatattctcagaggttagaaggattgagaattatagagttgaaggcatggagatctactctacaacactttggcatcttcaaaaagatgttgctctttcagttctgtcaaaagacttaacagacatggataaaaattcgccagaggcctggtgtgctgcagggaactgtttcagtctgcaacgggaacatgatattgcaattaaattcttccagagagctatccaagttgatccaaattacgcttatgcctatactctattagggcatgagtttgtcttaactgaagaattggacaaagcattagcttgttttcgaaatgctatcagagtcaatcctagacattataatgcatggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttct

SEQ ID NO: 5327 - DNA, 3177 bp, Homo sapiens
gaggatgacggtgctgcaggaacccgtccaggctgctatatggcaagcactaaaccactatgcttaccgagatgcggttttcctcgcagaacgcctttatgcagaagtacactcagaagaagccttgtttttactggcaacctgttattaccgctcaggaaaggcatataaagcatatagactcttgaaaggacacagttgtactacaccgcaatgcaaatacctgcttgcaaaatgttgtgttgatctcagcaagcttgcagaaggggaacaaatcttatctggtggagtgtttaataagcagaaaagccatgatgatattgttactgagtttggtgattcagcttgctttactctttcattgttgggacatgtatattgcaagacagatcggcttgccaaaggatcagaatgttaccaaaagagccttagtttaaatcctttcctctggtctccctttgaatcattatgtgaaataggtgaaaagccagatcctgaccaaacatttaaattcacatctttacagaactttagcaactgtctgcccaactcttgcacaacacaagtacctaatcatagtttatctcacagacagcctgagacagttcttacggaaacaccccaggacacaattgaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaagttttgggattttgccattagaaaccccaagtcctggagatggatcctatttacaaaactacactaatacacctcctgtaattgatgtgccatccaccggagccccttcaaaaaagacttttcgtgttttacagtctgttgccagaatcggccaaactggaacaaagtctgtcttctcacagagtggaaatagccgagaggtaactccaattcttgcacaaacacaaagttctggtccacaaacaagtacaacacctcaggtattgagccccactattacatctcccccaaacgcactgcctcgaagaagttcacgactctttactagtgacagctccacaaccaaggagaatagcaaaaaattaaaaatgaagtttccacctaaaatcccaaacagaaaaacaaaaagtaaaactaataaaggaggaataactcaacctaacataaatgatagcctggaaattacaaaattggactcttccatcatttcagaagggaaaatatccacaatcacacctcagattcaggcctttaatctacaaaaagcagcagcagaaggtttgatgagccttcttcgtgaaatggggaaaggttatttagctttgtgttcatacaactgcaaagaagctataaatattttgagccatctaccttctcaccactacaatactggttgggtactgtgccaaattggaagggcctattttgaactttcagagtacatgcaagctgaaagaatattctcagaggttagaaggattgagaattatagagttgaaggcatggagatctactctacaacactttggcatcttcaaaaagatgttgctctttcagttctgtcaaaagacttaacagacatggataaaaattcgccagaggcctggtgtgctgcagggaactgtttcagtctgcaacgggaacatgatattgcaattaaattcttccagagagctatccaagttgatccaaattacgcttatgcctatactctattagggcatgagtttgtcttaactgaagaattggacaaagcattagcttgttttcgaaatgctatcagagtcaatcctagacattataatgcatggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaaggaagagttatgctttatcttgaaggaaccattagatatggaaaatagtgatgaaccagagtttcttggttgctttttcaaaaatttgtttttatttggttctgttcctgataaacagagtaactgaccttcatttctaggttcttcaagaatggtgtttgcaagtgccagatggaacaataaaagacgttgcctataacagtgacttgattgccaaggaatgtaaattaccttaaacttgcagtatctcccataaacaaatgtaatgggcatattgggactcgtatgtaggaatcaaatatccctccatacagtgtactcttattcttggcaagaatgctttaatgtctaaccaagaattttaatttattcatcttgcttcaaa

SEQ ID NO: 5328 - DNA, 3848 bp, Homo sapiens
ctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagttatgtgatttcaggagatggaaatggaaaattaaacatttgggactggaagaccacaaaactctacagtcgatttaaagctcatgataaagtgtgtataggtgcagtgtggcatcctcatgaaacttctaaggtcataacatgtggttgggatggtctcattaaattgtgggattaatgagattaatccttaaactagctgggatcatttttgatccattgtcatatttatatttaattattaaatgtatctgatgataacttgatttacagataatgttgatgacattgaccctttgtttaaaaaaagaaactgtaaatttgacataatttcatttgcaacttcattttgttttttataaatgttatttatacagaaagtggctattgactttctatttgacaagtagttataattggcaagcagtttgagtttatactcatgacatactgaaagcatctctttggggtcaagaaagaatccctagtggatttgggattctagaggaggtgttataattaattattcagaaaaatgcatgtatttacctcttcaaccaaaagggcagtaaagaatagggataatatattttaatgtaaatttggaagaaggataaaatcacccacagttactctccctattattttcactgggtcaagttttaatcttttggcttcatgagttccactccctttgatgatatatgttgtatatttttagttgtaaagcagtaatctttaactgtagcattcctctaattataaacagtgaaaaatcaaaatcagtccagagttcttttgttgacttaattcctgatcagtatagacaggactatatatatttaatcagagaattacattatatctgaagatggagctcaggagaatgcaccaagactttgaattgtatttacattcactgtcagtaaagacctggctacgctttgagaaatcaggatctcctaggtcattgcttcgcagctgtgattactgaaatcctcctcataggagataaagtacgaggggtagagtccaagatgtcaacttgtaatttctttgaagtcatatgttttatctttaaaattattcttattttacctgtgaatatatacaacagaactttttaagattaaaaaatttttaaacctctatgtctgaaaaaaaaaatgacactcctggaagatggctagggttccccagtttgagaagcagtggccatggtgaaaaatagtttttgaaaacatcagattataaaatcaagatagtccggacgcggtggcacatgcctgtaatcccagcactttgggaggctgaggcaggtgaatcacctgaggtcaggagttcaagaccagcctggccaacatagtgaaaccccgtctctactaaaaacacaaaaattagccaggcttggtggctggcgcctgtaattccagctactcagaaggctgaggcagggagaattgcttgaacccaggagtggaggttgcagtgagctgagatcatgccactgcactccagcctgggcgacagagcgagactccacctcaaaaaataaaatcaagataacctcttgaatgtaatagctcatagcactttaatttggcaagccatttttcctgttttattataaatctatattagatgtttgaatatggtttgaaatatttcactaccgtgctgaaaaaggttggttgatagcagcttggagtgctaactggaagatcaaaatcatgtctcttgctgataacctaagagcattaagctctgagtccagtgaggtcatagcagtgtatgctccttgcccttacggagtgtctgtttttagaaatttagattttaaaaggcgtgggacatacgaccaggccctatagccacataaatataaatttcatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtaagtgtgtataaaagtctcctttttaaaaagatcatatttttaaataaagcattttttgt

SEQ ID NO: 5329 - DNA, 1977 bp, Homo sapiens
ctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagagtccctcagagctttcagaatctgaaggaggtgactgcaggtccccaggaggggtgaggaggatggcaagtgggtgaaggtccagacctcaactcaagagcagctcccctttgatctccttgacatatttggaatccctcacaaatttgcatttgggaaaagagctctcctgcttaaaaaaaatatgaaagcctctatcaataatttattcttaacagcttttgtaatgatttaatttatttaatcagtcctccttctggtggccatatagatattttcccaaatggatgatgttacaaactgatgttatcaacaaactgggcaactaagtttgtgtgtgtgttctgtcattttgtaaaacagaattctgaaaagaagtgttgtaaatga

SEQ ID NO: 5330 - DNA, 3927 bp, Homo sapiens
cgcgctgcacgctgggagtgcaggaccgcgaggcctcaaggacctgggagcctcttcttcttccgccctggcagggtctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagttatgtgatttcaggagatggaaatggaaaattaaacatttgggactggaagaccacaaaactctacagtcgatttaaagctcatgataaagtgtgtataggtgcagtgtggcatcctcatgaaacttctaaggtcataacatgtggttgggatggtctcattaaattgtgggattaatgagattaatccttaaactagctgggatcatttttgatccattgtcatatttatatttaattattaaatgtatctgatgataacttgatttacagataatgttgatgacattgaccctttgtttaaaaaaagaaactgtaaatttgacataatttcatttgcaacttcattttgttttttataaatgttatttatacagaaagtggctattgactttctatttgacaagtagttataattggcaagcagtttgagtttatactcatgacatactgaaagcatctctttggggtcaagaaagaatccctagtggatttgggattctagaggaggtgttataattaattattcagaaaaatgcatgtatttacctcttcaaccaaaagggcagtaaagaatagggataatatattttaatgtaaatttggaagaaggataaaatcacccacagttactctccctattattttcactgggtcaagttttaatcttttggcttcatgagttccactccctttgatgatatatgttgtatatttttagttgtaaagcagtaatctttaactgtagcattcctctaattataaacagtgaaaaatcaaaatcagtccagagttcttttgttgacttaattcctgatcagtatagacaggactatatatatttaatcagagaattacattatatctgaagatggagctcaggagaatgcaccaagactttgaattgtatttacattcactgtcagtaaagacctggctacgctttgagaaatcaggatctcctaggtcattgcttcgcagctgtgattactgaaatcctcctcataggagataaagtacgaggggtagagtccaagatgtcaacttgtaatttctttgaagtcatatgttttatctttaaaattattcttattttacctgtgaatatatacaacagaactttttaagattaaaaaatttttaaacctctatgtctgaaaaaaaaaatgacactcctggaagatggctagggttccccagtttgagaagcagtggccatggtgaaaaatagtttttgaaaacatcagattataaaatcaagatagtccggacgcggtggcacatgcctgtaatcccagcactttgggaggctgaggcaggtgaatcacctgaggtcaggagttcaagaccagcctggccaacatagtgaaaccccgtctctactaaaaacacaaaaattagccaggcttggtggctggcgcctgtaattccagctactcagaaggctgaggcagggagaattgcttgaacccaggagtggaggttgcagtgagctgagatcatgccactgcactccagcctgggcgacagagcgagactccacctcaaaaaataaaatcaagataacctcttgaatgtaatagctcatagcactttaatttggcaagccatttttcctgttttattataaatctatattagatgtttgaatatggtttgaaatatttcactaccgtgctgaaaaaggttggttgatagcagcttggagtgctaactggaagatcaaaatcatgtctcttgctgataacctaagagcattaagctctgagtccagtgaggtcatagcagtgtatgctccttgcccttacggagtgtctgtttttagaaatttagattttaaaaggcgtgggacatacgaccaggccctatagccacataaatataaatttcatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtaagtgtgtataaaagtctcctttttaaaaagatcatatttttaaataaagcattttttgtag

SEQ ID NO: 5331 - DNA, 2063 bp, Homo sapiens
cgcgctgcacgctgggagtgcaggaccgcgaggcctcaagatctgtcaggacctgggagcctcttcttcttccgccctggcagggtctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagagtccctcagagctttcagaatctgaaggaggtgactgcaggtccccaggaggggtgaggaggatggcaagtgggtgaaggtccagacctcaactcaagagcagctcccctttgatctccttgacatatttggaatccctcacaaatttgcatttgggaaaagagctctcctgcttaaaaaaaatatgaaagcctctatcaataatttattcttaacagcttttgtaatgatttaatttatttaatcagtcctccttctggtggccatatagatattttcccaaatggatgatgttacaaactgatgttatcaacaaactgggcaactaagtttgtgtgtgtgttctgtcattttgtaaaacagaattctgaaaagaagtgttgtaaatga

SEQ ID NO: 5332 - DNA, 400 bp, Homo sapiens
aaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagtaagctttgatgtttttaattgtcaattcaggtatacgctgtatctctatgaaggatatctacattaataaacttgagatttctttagagaa

SEQ ID NO: 5333 - DNA, 1119 bp, Homo sapiens
gaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatc

SEQ ID NO: 5334 - DNA, 306 bp, Homo sapiens
aagagctgagtcctgctaagtagcgttcgctgccttcctctgttaatattcaatgtctttaagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaag

SEQ ID NO: 5335 - DNA, 3173 bp, Homo sapiens
ttggagacggcgacccaggcatctggggagccacagaagtcgtactcccttaaaccctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggagggatctgtaggcctttctgtccagcgctctgtttttggagaaagaaatttcaatatacacagctccatttcacatgagagccctgcagtgaaactcatgaagcagtcaaagactgtggatgtactgtctagaaagttagcaacaaaaaagaaggctatttctacaaaagttatgaatagtgctgtgatgaggaaaactgccagttcttgcccagctagcctgacctgtgactgctatgcaacagataaagtttgtagtatttgcctttcaaggcgtcagcaggttgcccctagggcaggtacaccaggattcagagcaccagaggtcttgacaaagtgccccaatcaaactacagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttgggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctgcgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaatttgaatgctcttgaatttgtatattcaataaagttatccttttatatttttta

SEQ ID NO: 5336 - DNA, 3069 bp, Homo sapiens
aagtgttgcgcaggcgcatccgatcgactcggtaggtggggatctcttggagacggcgacccaggcatctggggagccacagaagtcgtactcccttaaaccctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggagggatctgtaggcctttctgtccagcgctctgtttttggagaaagaaatttcaatatacacagctccatttcacatgagagccctgcagtgaaactcatgaagcagtcaaagactgtggatgtactgtctagaaagttagcaacaaaaaagaaggctatttctacaaaagttatgaatagtgctgtgatgaggaaaactgccagttcttgcccagctagcctgacctgtgactgctatgcaacagataaagtttgtagtatttgcctttcaaggcgtcagcaggttgcccctagggcaggtacaccaggattcagagcaccagaggtcttgacaaagtgccccaatcaaactacagggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctgcgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaatttgaatgctcttgaatttgtatattcaataaagttatccttttatatttttta

SEQ ID NO: 5337 - DNA, 701 bp, Homo sapiens
cggtccttcccggctgagctcgcggccagcgctggccggcggattcccattcattcacccttctcctcctccgcccagtactcgtggccagggtcgtatcagttctccgtcaacttgcttggggccttggacgagcctcctggcgcttcctgtcagtggcgaaaagctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatata

SEQ ID NO: 5338 - DNA, 3313 bp, Homo sapiens
atctggttcggtctctggcccgagggaagccggtccttcccggctgagctcgcggccagcgctggccggcggattcccattcattcacccttctcctcctccgcccagtactcgtggccagggtcgtatcagttctccgtcaacttgcttggggccttggacgagcctcctggcgcttcctgtcagtggcgaaaagctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggagggatctgtaggcctttctgtccagcgctctgtttttggagaaagaaatttcaatatacacagctccatttcacatgagagccctgcagtgaaactcatgaagcagtcaaagactgtggatgtactgtctagaaagttagcaacaaaaaagaaggctatttctacaaaagttatgaatagtgctgtgatgaggaaaactgccagttcttgcccagctagcctgacctgtgactgctatgcaacagataaagtttgtagtatttgcctttcaaggcgtcagcaggttgcccctagggcaggtacaccaggattcagagcaccagaggtcttgacaaagtgccccaatcaaactacagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttgggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctgcgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaatttgaatgctcttgaatttgtatattcaataaagttatccttttatatttttta

SEQ ID NO: 5339 - DNA, 1866 bp, Homo sapiens
gttgcgcaggcgcatccgatcgactcggtaggtggggatctcttggagacggcgacccaggcatctggggagccacagaagtcgtactcccttaaaccctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggagggatctgtaggcctttctgtccagcgctctgtttttggagaaagaaatttcaatatacacagctccatttcacatgagagccctgcagtgaaactcatgaagcagtcaaagactgtggatgtactgtctagaaagttagcaacaaaaaagaaggctatttctacaaaagttatgaatagtgctgtgatgaggaaaactgccagttcttgcccagctagcctgacctgtgactgctatgcaacagataaagtttgtagtatttgcctttcaaggcgtcagcaggttgcccctagggcaggtacaccaggattcagagcaccagaggtcttgacaaagtgccccaatcaaactacagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttgggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagc

SEQ ID NO: 5340 - DNA, 4683 bp, Homo sapiens
gaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctacttgggaggctgaggcaggagaatcgcttgaacccaggaggcggaggttgcagtcactcaggatcatgcagctacactccagcctgggcgacaagagtgaaactccatctcaaaaagaaaaaaaaaaaaaatcagtttatttgaaagacagtatatcagaaagaaagaagcaatagagaactagtattgttctttatgggttagactttacataatattagttgtcctgatgtcaatgttactgctttcaattaatttttctactttcccagaatagcatctatattccttttaattttgagggtttaaaaaaaaatgcagtgtatgtcaaatttacagtttagtaccaagccagtagatgtcagtatgatgccttaaattaagtcttctttaattaaagatatttttttaaattaa

SEQ ID NO: 5341 - DNA, 3813 bp, Homo sapiens
gaagttggcgcatgcgcctaaagctgacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaa

SEQ ID NO: 5342 - DNA, 552 bp, Homo sapiens
cttcagagcaagcgcaagacatatagccccgctcattgttaagcgaggccaaggcaacccttaggcgcgctctatttcccctttcgtagcgaaagggccaggcgtattgagcggtcaggggagcgcgcacgcagaacgtcagccaatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctg

SEQ ID NO: 5343 - DNA, 754 bp, Homo sapiens
agttggcgcatgcgcctaaagctgacgggtttgaaatggcttcgatgttagccgggacccgactcaggtgaaggtctggtccccgtagttggagcagtgggcggccaagccgggtctcttaacatcttgtcgaatctgtggaagggccgggagcgatcttttgggtagcccggcggccccgggcggcgacgatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagcaatattcacaacctcagcaggccctgtatagtgtgcaacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcag

SEQ ID NO: 5344 - DNA, 3224 bp, Homo sapiens
gacgggtttgaaatggcttcgatgttagccgggacccgactcagatcgatgctatagaagacaaacaagggaaggttttttttccttttgcatcatggctcaatttggaggacagaagaatccgccatgggctactcagtttacagccactgcagtatcacagccagctgcactgggtgttcaacagccatcactccttggagcatctcctaccatttatacacagcaaactgcattggcagcagcaggccttaccacacaaactccagcaaactatcagttaacacaaactgctgcattgcagcaacaagccgcagctgcagcagctgcattacaacagttacagcaaccccagcaaaccctcttaacacagccagctgttgcactgcctacaagccttagcctgtctactcctcagccaacagcacaaataactgtatcatatccaacaccaaggtccagtcaacagcaaacccagcctcagaagcagcgtgttttcacaggggtggttacaaaactacatgatacgtttggatttgtggatgaagatgtattctttcagcttagtgctgtcaaagggaaaaccccccaagtaggtgacagagtattggttgaagctacttataatcctaatatgccttttaaatggaatgcacagagaattcaaacactaccaaatcagaatcagtcgcaaacccagccattactgaagactcctcctgctgtacttcagccaattgcaccacagacaacatttggtgttcagactcagccccagccccagtcactgctgcaggcacagatttcagcagcttctattacaccactattgcagactcaaccacagcccttattacagcagcctcagcaaaaagctggtttattgcagcctcctgttcgtatagtttcacagccacaaccggcacgacgattagatcccccatcccgattttcaggaagaaatgacagaggggatcaagtgcctaacagaaaagatgatcgaagtcgtgagagagagagagaaagacgtagatcgagagaaagatcacctcagaggaaacgttcccgggaaagatctccacgaagagagcgagagcgatcacctcggagagttcgacgtgttgttccacgttacacagttcagttttcaaagttttctttagattgtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaatgcacagagaagtagagtccttagaaaaaaatatggccattcttgatccaccagatgctgaccacttatacagtgcaaaggtaatgctgatggctagccctagtatggaagatttatatcataagtcatgtgctcttgctgaggacccacaagaacttcgagatggattccaacatcctgctagacttgttaagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggatgaagaagagaaggatgatggtgaagctaaagaaatttctacacctacccattggtctaaacttgatccaaagacaatgaaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggaagaagaaaggaaacgtcaagaggaaatagaacgccagcgtcgagaaagaagatatattttgcctgatgaaccggccatcattgtacatccaaattgggctgcaaaaagtggcaagtttgattgtagcatcatgtctttgagtgtcctattggactacagattagaggataataaagaacattcatttgaggtttcattgtttgcggaacttttcaacgaaatgcttcaaagagattttggtgtccgtatatacaaatcattactgtctcttcctgagaaagaggacaaaaaagaaaaggataaaaaaagcaaaaaagatgagagaaaagataaaaaagaagaaagagatgatgaaactgatgaaccaaaacccaaacggagaaaatcaggcgatgataaagataaaaaagaagatagagatgaaaggaagaaagaagataaaagaaaagatgattctaaagatgatgatgaaactgaagaagataacaatcaagatgaatatgaccctatggaagcagaagaagctgaggatgaagaagatgatagggatgaggaagaaatgaccaaacgagatgacaaaagagatatcaacagatactgcaaggagaggccctctaaagataaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaaagaagcttcttaataaagtagtgctccgtgaatcttgcttttaccggaaattaacagacacctcaaaagatgaagagaaccatgaagagtctgagtcattgcaggaagatatgctaggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactag

SEQ ID NO: 5345 - DNA, 2513 bp, Homo sapiens
agcgcagcgtcgaccctttgtggacgccgagtggcggtcgctcgccccgccccgcgccgtcgggcgctccttcctcagcggcgggaagctggcggcagcggcggtggcggtggctgagcagaggacccggcgggcggcctcgcgggtcaggacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaacctgtgccgctcagtcctcattgccaacacggtccggcagatccaagaggagatgacgcaggatgggacgtggcgcacagtggcaccccaggctgcagagcgggcgccgctcgaccgcttggtctccacggagatcctgtgccgtgcagcgtgggggcaagagggggcacatcctgctcctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacacgtgagcactggctcccacggagggtgcgcctgccgccagcggcccagccttgctgccctgtctgctgattctgagaaatcccagaacagcccattaccagtggggctgcagccctaggcccgtcccactcacctcccccctgtggagcgccaggcagaggctgttctggaaggcttcttgtcttctgacgtccccacagccctgggcccctcgtgtctctttgtgtcccccactgtagaggacggtgagccgcagctgcatcaacctccttttacctttagataggtgaatttttacaattcagttttacatgttttgggcagtattttgtcttaagatatattttttaaactttttataccttatctctttagattttttcagctattttcttaaaagtatattttttctataaacatcctttgctgctacattagaacttttatagcctaaacaattgcagttggtgtgtttcatttttttaaggtttaaataagggttttttgttttgttttgttttttgcagtgagcatcactacagtctcagtcaacagtgtgaatgtatcatgttttactttaaatgtgtgtgtgatacttcttcattatgtcctgcgctgcagtgagacctgggtgaaaatcaggagccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccatcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaatgggaatgtggtgttagttacgaccacggcctgaccctccagcaacctttctgcaggatcagttctgctgtattatctggtggtgctttctaaggtggggaaaggaattgcacttggctgcattaaatggacgctgggttacttttatttcccccccccacagggttgcagagcaaattctttttacattgttcagcgcccggctggagttgggggtgtccacgacctctgacagcccccgatgtcgaaagttaatcctcatggaccctagtttaaagggtatgtgttttataggaataaatctaaagcactattttgtttctgtatagcatttttatcttttagaaacatcatttgttcagc

SEQ ID NO: 5346 - DNA, 1536 bp, Homo sapiens
ctggcggcagcggcggtggcggtggctgagcagaggacccggcgggcggcctcgcgggtcaggacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaacctgtgccgctcagtcctcattgccaacacggtccggcagatccaagaggagatgacgcaggatgggacgtggcgcacagtggcaccccaggctgcagagcgggcgccgctcgaccgcttggtctccacggagatcctgtgccgtgcagcgtgggggcaagagggggcacatcctgctcctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacactgagcatcactacagtctcagtcaacagtgtgaatgtatcatgttttactttaaatgtgtgtgtgatacttcttcattatgtcctgcgctgcagtgagacctgggtgaaaatcaggagccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccatcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaa

SEQ ID NO: 5347 - DNA, 2587 bp, Homo sapiens
gacgggtggaaaagactcggggttccgagggccgcagaccgctagccctacgtcacttccgcttcctttcccgcagggcgggtaattcgaacgttttttgcagcgagtggccttcccggttggcgcgcgcccggggcggcggcgctggaggagctcgagacggagcctaagttatgtctgggaggcgaacgcggtccggaggagccgctcagcgctccgggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccaggggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgttcat

SEQ ID NO: 5348 - DNA, 217 bp, Homo sapiens
accagttcttagatcaggaggactggggcccccagcggacctcaaaggagatcaggcagttgcagaatgactgcatgaggcttcgggagtcactgaacaccacccaagtgcacaacctggccctgggggagaagctgcagaacctgcccaccttattgtataagagcctgaaggagggagcccaggccatccaggaggaggcccaggccatccagga

SEQ ID NO: 5349 - DNA, 2789 bp, Homo sapiens
ctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaaacctaaattcaggtcagatatcagtgaagaactggcaaatgttttttatgaggactctgataatgaatctttctgcggcttttcagaaagtgaggtgcaagatgtattagaccattgtggatttttacagaaaccaaggccagatgtcactaacgaactggccggtatttttcatgccgactctgacgatgaatcattttgcggtttctcagagagtgagatacaagatggaatgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcacagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaacttgtctgcttttttaaaaataatcttactgtacttaattctaattttttcctcatatttaaataaaaggccatttccaccttttctaaaaaa

SEQ ID NO: 5350 - DNA, 2500 bp, Homo sapiens
cccgagccccgcccctccgggcccgggtcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcacagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaa

SEQ ID NO: 5351 - DNA, 2405 bp, Homo sapiens
gcgcccagcctgccagccgcgctgctgctgctcctcctgctgtgggaccgctgaccgcgcggctgctccgctctccccgctccaagcgccgatctgggcacccgccaccagcatggacgctcgccgcgtgccgcagaaagatctcagagtaaagaagaacttaaagaaattcagatatgtgaagttgatttccatggaaacctcgtcatcctctgatgacagttgtgacagctttgcttctgataattttgcaaacacgaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatgcttgcaaaactcatgtctgaattagaaagcttccctggctcgttccgtggaagacatcccctcccaggctccgactcacaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgaagatgacctgcccagaagccgtcgctccagatcatccgtgacccttccgcatataattcgcccagtggaagaaattacagaggaggagttggagaacgtctgcagcaattctcgagagaagatatataaccgttcactgaactggcattgcccgccttgtcgaggaatctgcaactgcagtttctgccggcagcgagatggacggtgtgcgactggggtccttgtgtatttagccaaatatcatggctttgggaatgtgcatgcctacttgaaaagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcacagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaacttgtctgcttttttaaaaataatcttactgtacttaattctaattttttcctcatatttaaataaaaggccatttccaccttttct

SEQ ID NO: 5352 - DNA, 2915 bp, Homo sapiens
ggtgcgccgggccgtggtgagtccgggctcccgtggccgcgtgctgggaggagactggagcccggttaggaagaatggagttggcgactcgctaccagagcacttcgcaggcatagtttggaagtcatcagggctggttcttttccttccagatccctaaagaagtggctgacatctttaacgcccccagtgatgatgaagagtttgttggcttccgagatgatgttcccatggaaaccctctcgtcagaggagagctgcgatagttttgactcactagagtcagggaaacagcaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaagaggaaaacaaacagaaccagccacctcaccatagagtactccaacaagacatgcataccattggtgcctaagaaagatttttttacagttgtgtttttatacagaaattctttgtagaaattactattttttgttaaagattgtttatatgcttacaaagatttctcaggaagacagcagagcagaggaatctatatagatgtatgcacagacctgtctgtatgctgaactttgttaaaaatatctgccagttattaaaaagcacagtttaaatggggtggggttaaagttcaggtaagtaagttagagagaaaacattgtatgatcagctcctgcacttgatctatctatctttggcttcccaaacagtaactcactccaggccaagtgtgccttagcacgagtgaccacagtttaatagaccacacacatcgtttaacctgctcttggtcattggaaatttacactgaacaaagtgcaattaactgtagaacagttttatttttattaaaacttgactgaacaaaaggggaccatcaacattgtagacactggacactggaggccttacagagtgctagcctcttccttcaggactcacctggggcctgctgcttttatattttgaaagagtttaagggctaataatttaatttgttgtttgttaaaaattaaaatctccgttctttccggctgcattgcttttgcatgttcacatatgatgtacttttatgatgtacttttttttttttgagatggagtcttgttctgttgcccaggagggagtgcagtggtgcaacctcggctcactgcaacctttgcctcctaggttcaagtgattctcctacctcctgagtaactgggattacagtcgtgtgccaccacgctcagccctgagttagtttctagtatttttttctgactttcactctaaggatagcgttgaaaaaagaatgcacgtgtgagttactaaaaagttagaataatgtgcatgggaacagtgcagcaacatgctagaaaatcctcactgcactccagcagaggctagaggaatgccagtgttaccttacgcttctagaagcagagccactccagccagaacccattttgcagtcttctcttcgctcttcagcctgaaggtccagatgtagctggggcctctcagtttggttctatacacagggcactcgtaggtctgtttggtttcttgtctgtccacgggggtggcttttgcaaagatgaccggcatagggcatgccagctccttgagacgggcttcaacaatggttcctgcttgggtgtcccagcgggcgcctatggcaaaaacacagcggttgcaattgtgtggcagcttgctactaatgataatgatcaagtaagttgtttgatgcaataaacattcaacattctggttttgtcat

SEQ ID NO: 5353 - DNA, 1830 bp, Homo sapiens
gttcttggtgcgccgggccgtggtgagtccgggctcccgtggccgcgtgctgggaggagactggagcccggttaggaagaatggagttggcgactcgctaccagatccctaaagaagtggctgacatctttaacgcccccagtgatgatgaagagtttgttggcttccgagatgatgttcccatggaaaccctctcgtcagaggagagctgcgatagttttgactcactagagtcagggaaacaggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaagaggaaaacaaacagaaccagccacctcaccatagagtactccaacaagacatgcataccattggtgcctaagaaagatttttttacagttgtgtttttatacagaaattctttgtagaaattactattttttgttaaagattgtttatatgcttacaaagatttctcaggaagacagcagagcagaggaatctatatagatgtatgcacagacctgtctgtatgctgaactttgttaaaaatatctgccagttattaaaaagcacagtttaaatggggtggggttaaagttcaggtaagtaagttagagagaaaacattgtatgatcagctcctgcacttgatctatctatctttggcttcccaaacagtaactcactccaggccaagtgtgccttagcacgagtgaccacagtttaatagaccacacacatcgtttaacctgctcttggtcattggaaatttacactgaacaaagtgcaattaactgtagaacagttttatttttattaaaacttgactga

SEQ ID NO: 5354 - DNA, 3066 bp, Homo sapiens
aactgcagccccctctcgcgccgcctgcgaagacaaggtcagtggccgcgaagttggaacgtgatcggagccacgaggcccagtgaggcggcaccgagggggcagcgcaacgcgctccccctgtccagggcgtcaagtgcgcccctcccggggcccgcctgtgctccgggcggagcgcgctagctgctcgggcgcggggcgttcttggtgcgccgggccgtggtgagtccgggctcccgtggccgcgtgctgggaggagactggagcccggttaggaagaatggagttggcgactcgctaccagatccctaaagaagtggctgacatctttaacgcccccagtgatgatgaagagtttgttggcttccgagatgatgttcccatggaaaccctctcgtcagaggagagctgcgatagttttgactcactagagtcagggaaacagcaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccctagaagaagcaggtctagaagaagtagtattggtcttcgagtagcctttcagttccccaccaagaagctggccaacaaaccagataaaaacagttcttccgagcagttgttttctagcgcacgcttacagaatgagaaaaaaacaattcttgaaagaaagaaagactgtagacaggtgatacaaagggaagattctacctctgagtctgaggatgactctcgggatgagagccaggagagttcagatgctttgctgaaaaggaccatgaacatcaaggagaacaaagccatgcttgcccagttattggcggaattgaactcgatgccagatttcttcccagtacgaaccccaacctcagcttctaggaagaagacagtgaggcgggccttctcggagggacagatcacgcggcgtatgaacccaacccggagtgcgcggcctcctgagaagtttgctctagagaacttcactgtctcagccgctaaatttgcggaagagttttacagcttccgaagaaggaagacaattggggggaaatgccgggagtacagacgacgtcaccgtatatcttcttttcggccagtggaggatatcaccgaagaggacttagaaaatgttgccataactgttcgagataaaatctatgataaagttctgggtaacacgtgccatcagtgtcgacaaaagaccatcgacaccaagacagtgtgtcggaaccagggttgctgtggtgtgcgaggacagttctgtggaccatgcctgcggaaccgctatggggaggatgtcagatcggcattgctggacccggattgggtgtgtcccccctgtcgtgggatctgcaattgcagctactgtcggaagcgtgacggccgctgtgccacaggaatcctcattcatctggccaagttttatggttatgacaatgttaaggaatatctggagagcttacaaaaggagctggtagaagacaattaagaggaaaacaaacagaaccagccacctcaccatagagtactccaacaagacatgcataccattggtgcctaagaaagatttttttacagttgtgtttttatacagaaattctttgtagaaattactattttttgttaaagattgtttatatgcttacaaagatttctcaggaagacagcagagcagaggaatctatatagatgtatgcacagacctgtctgtatgctgaactttgttaaaaatatctgccagttattaaaaagcacagtttaaatggggtggggttaaagttcaggtaagtaagttagagagaaaacattgtatgatcagctcctgcacttgatctatctatctttggcttcccaaacagtaactcactccaggccaagtgtgccttagcacgagtgaccacagtttaatagaccacacacatcgtttaacctgctcttggtcattggaaatttacactgaacaaagtgcaattaactgtagaacagttttatttttattaaaacttgactgaacaaaaggggaccatcaacattgtagacactggacactggaggccttacagagtgctagcctcttccttcaggactcacctggggcctgctgcttttatattttgaaagagtttaagggctaataatttaatttgttgtttgttaaaaattaaaatctccgttctttccggctgcattgcttttgcatgttcacatatgatgtacttttatgatgtacttttttttttttgagatggagtcttgttctgttgcccaggagggagtgcagtggtgcaacctcggctcactgcaacctttgcctcctaggttcaagtgattctcctacctcctgagtaactgggattacagtcgtgtgccaccacgctcagccctgagttagtttctagtatttttttctgactttcactctaaggatagcgttgaaaaaagaatgcacgtgtgagttactaaaaagttagaataatgtgcatgggaacagtgcagcaacatgctagaaaatcctcactgcactccagcagaggctagaggaatgccagtgttaccttacgcttctagaagcagagccactccagccagaacccattttgcagtcttctcttcgctcttcagcctgaaggtccagatgtagctggggcctctcagtttggttctatacacagggcactcgtaggtctgtttggtttcttgtctgtccacgggggtggcttttgcaaagatgaccggcatagggcatgccagctccttgagacgggcttcaacaatggttcctgcttgggtgtcccagcgggcgcctatggcaaaaacacagcggttgcaattgtgtggcagcttgctactaatgataatgatcaagtaagttgtttgatgcaataaacattcaacattctggttttgtca

SEQ ID NO: 5355 - DNA, 563 bp, Homo sapiens
acttgttttattgagagtcgcgagactcactgcttccaccttgcttccgactggtgtttactttcctccacctgcgtgcctggcccgggagaaggggaggcggggccgccagcgttggaaggcgcagagtgcccggcgcccgagcccaaaccgctgtcacctgcccgagtctggcggcaaagactgagccactaacgatccctaaagaagtggctgacatctttaacgcccccagtgatgatgaagagtttgttggcttccgagatgatgttcccatggaaaccctctcgtcagaggagagctgcgatagttttgactcactagagtcagggaaacagcaggatgtgcgctttcattccaaatacttcacagaagagctaagaagaatttttatagaggacactgactcagagactgaggattttgcaggatttacgcagagtgatctgaatggaaagactaacccagaagtaatggtcgtggagtcagatttgagtgatgatggcaaagcatctttggtgagcgaggaagaggaagatgaagaagaagataaggctacccct

SEQ ID NO: 5356 - DNA, 2303 bp, Homo sapiens
gtgactgtggagtttgaattgggtggcggttgactgtagagccgctctctctcactggcacagcgaggttttgctcagcccttgtctcgggaccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggtgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttttctt

SEQ ID NO: 5357 - DNA, 2469 bp, Homo sapiens
gggccggcaggaacttgcttgtgattggatgttgtgggacggcggcttctcattcgtcagcctgtgactgtggagtttgaattgggtggcggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaagtggaaatacgaatcaagcaaattgagtcagacaggcagaacctcctcaaggaggtggataacctctacaacatcgagatcctgcggctccccaaggctctgcgcgagatgaactggcttgactacttcgcccttggaggaaacaaacaggccctggaagaggcggcaacagctgacctggatatcaccgaaataaacaaactaacagcagaagctattcagacacccctgaaatctgccaaaacacgaaaggtaatacaggtagatgaaatgatagtggaagaggaagaagaagaagaaaatgaacgtaagaatcttcaaactgcaagagtcaaaaggtgtcctccatccaagaagagaactcagtccatacaaggaaaaggaaaagggaaaaggtcaagccgtgctaacactgttaccccagccgtgggccgattggaggtgtccatggtcaaaccaactccaggcctgacacccaggtttgactcaagggtcttcaagacccctggcctgcgtactccagcagcaggagagcggatttacaacatctcagggaatggcagccctcttgctgacagcaaagagatcttcctcactgtgccagtgggcggcggagagagcctgcgattattggccagtgacttgcagaggcacagtattgcccagctggatccagaggccttgggaaacattaagaagctctccaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggtgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttttcttttgtaa

SEQ ID NO: 5358 - DNA, 772 bp, Homo sapiens
aaggcgcgcagcgctgggcgcaaagcgccagtctccgccttgcgagctcagagtgtgcccgctgcgccgccgctgtccgtacctgccgccgccgccaccgccaccatgcccaacttcgccggcacctggaagatgcgcagcagcgagaatttcgacgagctgctcaaggcactgggtgtgaacgccatgctgaggaaagtggccgtagcggctgcgtccaagccgcacgtggagatccgccaggacggggatcagttctacatcaagacatccaccacggtgcgcaccactgagatcaacttcaaggtcggagaaggctttgaggaggagaccgtggacggacgcaagtgcaggagtttagccacttgggagaatgagaacaagatccactgcacgcaaactcttcttgaaggggacggccccaaaacctactggacccgtgagctggccaacgatgaacttatcctgacgtttggcgccgatgacgtggtctgcaccagaatttatgtccgagagtgaaggcagctggcttgctcctactttcaggaagggatgcaggctcccctgaggaatatgtcatagttctgagctgccagtggaccgcccttttcccctaccaatattaggtgatcccgttttccccatgacaatgttgtagtgtcccccacccccaccccccaggccttggtgcctcttgtatccctagtgctccatagtttggcatttgcacggtttcgaagtcattaaactggttagacgtgtctcaaccttt

SEQ ID NO: 5359 - DNA, 456 bp, Homo sapiens
gattcaagtgctggctttgcgtccgcttccccatccacttactagcgcaggagaaggctatctcggtccccagagaagcctggacccacacgcgggctagatccagagaacctgacgacccggcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaa

SEQ ID NO: 5360 - DNA, 783 bp, Homo sapiens
ccagagaagcctggacccacacgcgggctagatccagagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagcccc

SEQ ID NO: 5361 - DNA, 992 bp, Homo sapiens
cgcgcgggagcccaggccagctttggggttgtccctggacttgtcttggttccagaacctgacgacccggcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagccccaaaccagcccagagcagggtctctctaaaggggacttgagggcctgagcaggaaagactggccctctagcttctaccctttgtccctgtagcctatacagtttagaatatttatttgttaattttattaaaatgctttaaaaaaataaaa

SEQ ID NO: 5362 - DNA, 1840 bp, Homo sapiens
ggttacgatagttacttttgttatgtattttaccacaatttttaaaaagcaaaccaaaaccaaccaagagtgcttcccccacacctcaaaatcatcctgcagcagctccctggcccagctctctctcaccctgaccctgggcccctctcccaccacccagggctagccctgtggaccaaccatctctgccagcccctccccgaccctccagccagggaggtggggcgctggccggtgaatggggcaggccaggcccaaaggctggcccagggctcaccagctctggactgggcgtcccgtctgaggtggggatgaccaacatgccagctctgggttttagctgaggatgggcacatcaagcactgacagccagcaagctgggcacaggcgatgctcaacctctaacacatcggctgagaacctcacctgcctctccctgcctgggagccctggcaagacagctcctctcccaggcccagcacaggcaggcgctggacagccacttcctaaggggtgcgcggccgtcaaggcagaggtgggtatccctgcacctcacacctctcaggaggtcaggatccacatccgtcgcctgctttcctgggctgcccctggggcttgtgggctgagatcaaccccttgtgccctgccccaggccctccctcaggcgaggccctgcccaggcaggtggttcttccctggctgttcccttccaacaggtggggcccagaccatcctatctctttggacctggagacatttccttaactgggctttgcagcagagggaagagaacagtggcagagccaggcgcgtacctcctgtgcccaggacagcacctgtaagcaagggggaagggagccacccaccccagaactcaaatggagagaaagtcaagacaatcacccctgacgtggggctgcaccaatccctgacgtctgaccccactgtggctgtcctcagagccaagagggctccagaagcccacccgcctcgaagctgttcagggagcctcacggcccgtgtttgccacatgggtgtgtgccagggccaaggggacacagaagatggcaggatgacactaatggggtgagcagggcacactggtgcctcccatactgccctccagcaccaggcagggtcaccacagccggcaagcactgggcctggggatgtgtgaagagatagggttattgagaagagaaaacagaacgctggtcatccgtggcactcagggctaggcagtccagggagcagaaaacaggggtcccgggcccagtctccctcctggaggtcagagcggagcccctggcactgtgccctggcccagaaccaggctgtgggctccacgctgcacaccccaactcaggagcagaaagcaaacccctgactgtccacactccctgtgactggtccccttcctgccggctcttcacccccagcccatggtggcttcaccccatggcaccagccactgactgcctgcccctccctcccatagtgacactttcctggggtctgcaggtctccggtccacttcatgcagacaggccctgtcccccactggggcccaaggcccaggctaaactacagcccagccatcccaccccaggccgtgaatgccttctccaggagggcaaccaaggatggtgccacatgtgagcacaagcaaaacccggagccaaggcgagtcctgctgggtgcacgtttatcccagccaccgcctccagggcggccgcacaggccctgggcatcaatccagcagggctcccgactcactccctggagaccaggggggacacgggctcacaccacacatctcagaggctaacaggtgggcagg

SEQ ID NO: 5363 - DNA, 1374 bp, Homo sapiens
ttacttttgttatgtattttaccacaatttttaaaaagcaaaccaaaaccaaccaagagtgcttcccccacacctcaaaatcatcctgcagcagctccctggcccagctctctctcaccctgaccctgggcccctctcccaccacccagggctagccctgtggaccaaccatctctgccagcccctccccgaccctccagccagggaggtggggcgctggccggtgaatggggcaggccaggcccaaaggctggcccagggctcaccagctctggactgggcgtcccgtctgaggtggggatgaccaacatgccagctctgggttttagctgaggatgggcacatcaagcactgacagccagcaagctgggcacaggcgatgctcaacctctaacacatcggctgagaacctcacctgcctctccctgcctgggagccctggcaagacagctcctctcccaggcccagcacaggcaggcgctggacagccacttcctaaggggtgcgcggccgtcaaggcagaggtgggtatccctgcacctcacacctctcaggaggtcaggatccacatccgtcgcctgctttcctgggctgcccctggggcttgtgggctgagatcaaccccttgtgccctgccccaggccctccctcaggcgaggccctgcccaggcaggtggttcttccctggctgttcccttccaacaggtggggcccagaccatcctatctctttggacctggagacatttccttaactgggctttgcagcagagggaagagaacagtggcagagccaggcgcgtacctcctgtgcccaggacagcacctgtaagcaagggggaagggagccacccaccccagaactcaaatggagagaaagtcaagacaatcacccctgacgtggggctgcaccaatccctgacgtctgaccccactgtggctgtcctcagagccaagagggctccagaagcccacccgcctcgaagctgttcagggagcctcacggcccgtgtttgccacatgggtgtgtgccagggccaaggggacacagaagatggcaggatgacactaatggggtgagcagggcacactggtgcctcccatactgccctccagcaccaggcagggtcaccacagccggcaagcactgggcctggggatgtgtgaagagatagggttattgagaagagaaaacagaacgctggtcatccgtggcactcagggctaggcagtccagggagcagaaaacaggggtcccgggcccagtctccctcctggaggtcagagcggagcccctggcactgtgccctggcccagaaccaggctgtgggctccacgctgcacaccccaactcaggagcagaaagcaaacccct

SEQ ID NO: 5364 - DNA, 4248 bp, Homo sapiens
agggaacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggctgataaagaatttgtatggtctttgtggaaacgtctccaggttacaaacccagatctcacacaagtggtcagtttggttgtggaaagagaaaaacagaaatctgaagctaaagacagaaaagttctagaaattctgcaagtcaaggatgccaaaatacaagaatttgaacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaagacctttgaagacaatttaattgaagcaaggaaagaagttgaagtatcacagagtaaatacaatgctctatcattacagttgagtaataaacagactgaacttatccagaaggatatggatattaccctggtcaggcaagaactgcaggagctgcagaatctttacaaacagaacagtacacatacagcccagcaagcagagctgatccagcagcttcaggttctcaatatggacacacaaaaagtactgagaaatcaggaagatgttcacacagctgaaagtatatcatatcaaaaactttacaatgagttacatatttgttttgaaaccacaaaatcaaatgaagctatgctccggcaaagtgttactaatcttcaggatcagctattacaaaaagagcaagaaaatgctaagttaaaagaaaaacttcaggaatcacagggagcacctcttcctttacctcaagaaagtgatccagactactcagcacaggtacctcatcgcccatccttatcaagcttagaaacgttaatggtttcacagaagtctgaaattgagtatttacaggagaaactaaagatagcaaatgaaaaactgtcagaaaacatatctgccaacaagggtttctcccgaaagagcatcatgacaagtgctgaaggaaaacataaggaaccacctgtgaaacgttcaaggtctttgtccccaaagagctctttcacagactcagaagagctacagaagctgagaaaagctgaaagaaagattgaaaacttagagaaggcactacaactaaagagccaagaaaatgatgagctaagagatgcccatgaaaaacgcaaggaacggctacagatgttacagaccaactacagagcagtaaaagagcaattaaaacagtgggaagaaggcagtggcatgactgaaatcaggaaaataaagagagcagatccccaacaacttcgacaagaagattctgacgctgtgtggaatgaactggcatatttcaaaagggaaaaccaggagctaatgattcaaaagatgaatcttgaagaagaattagatgaacttaaagtacatatatctattgataaggcagcaatacaagaattgaatagatgtgtggcagagagaagagaagaacagctctttagatctggtgaagatgatgaggtcaagaggagtactccagagaagaatggaaaagaaatgttggagcagacattacagaaggtcactgagttggaaaatcggctgaaatcttttgagaaaaggtcgagaaaattaaaagaagggaataaaaaattaatgaaagaaaatgattttctgaaatccctcttaaaacagcaacaagaagatacagagaccagagaaaaagagctagaacagataataaaggggagtaaagatgtagaaaaagaaaatactgaacttcaagtaaaaatcagtgagctggagacagaagtcacttccctgaggagacaagtggcagaagctaatgcattgagaaatgaaaatgaagagctgatcaacccaatggagaaatcacaccagtcagcagacagagctaaatccgagatggccaccatgaaagtgagatctggacgatatgattgtaagacaactatgaccaaggttaaatttaaagctgcgaagaaaaattgctctgtgggtcgtcaccacactgttctcaatcattccatcaaggttatgagcaatgtgtttgagaacctcagcaaggacggctgggaggatgtgagtgaaagcagcagtgattctgaagcacagacctctcaaactttgggaacaattattgtagaaacatcccagaaaataagtcctacggaagatggaaaagaccagaaagaaagtgatccaacagaagacagccaaacacaaggaaaagaaatagtacagacatatttaaatatagatggcaagaccccaaaggactattttcatgataagaatgccaaaaaaccaacttttcaaaagaagaattgcaagatgcaaaagagttcacatacagcagttcctactagagtcaacagagaaaagtacaaaaatataactgcccagaaatcaagtagcaatattattttattacgagaacggattatatccttgcaacaacaaaacagtgtacttcagaatgccaagaaaacagcagaattgtctgttaaagaatataaagaagttaatgaaaagctcctccatcaacagcaagtatccgatcaacgatttcagacaagcaggcagacaataaagaagctaaatttggatttggctgggcttcggaaagaaaaagaagatttactaaagaaattggagtcctcatctgaaatcacaagtttggcagaagaaaattcccaggtaacatttccacggatacaagttacatcacttagtccttcaaggagcatggatttggaaatgaagcaattgcagtataaactaaagaatgctactaatgaactcactaaacagtcatcaaatgtgaagactttgaaatttgaactcctagcaaaagaagaacacataaaggaaatgcatgaaaagatatctcgaatggagagggatataactatgaaaagacatttgatagaggacttgaaatttcgacagaaagtaaatttggaaagtaacaagagttttagtgaaatgttacaaaatcttgataaaaaggtaaagacattaactgaagaatgttccaacaagaaggtatcaattgattcactaaagcaaagacttaacgttgctgtaaaagaaaagtcacagtatgaacagatgtatcagaaatctaaagaggagttagaaaaaaaggatctcaagcttactctcctagtatcaagaataagtgagactgaatctgcaatggcagaaattgaaacagcagcatctaagcagcttcaagaattagcattgcaaagtgaacaggtcctagaaggtgcacagaagacattgctgttagccaatgaaaaagtagaagagttcaccacatttgtgaaggctttggccaaagagttgcaaaatgatgtccatgtggtaaggcgacaaataagagagcttaaaaaaatgaagaaaaacagggacgcctgtaaaacctcaacccataaagcccagaccttggcagcttctatcctgaacatttcacggtcagatttagaggaaatattagacacagaagatcaagtggaaattgaaaaaacaaaaattgatgctgaaaatgacaaggaatggatgttgtacattcagaaacttcttgaaggacagagtcttgctctgtctcccaggctgaagtgcaatggcgcaatcgtggctcaccaaaacctccgcctgccagactcgagcagttctgcctcagcctcctga

SEQ ID NO: 5365 - DNA, 2061 bp, Homo sapiens
aacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggctgataaagaatttgtatggtctttgtggaaacgtctccaggttacaaacccagatctcacacaagtggtcagtttggttgtggaaagagaaaaacagaaatctgaagctaaagacagaaaagttctagaaattctgcaagtcaaggatgccaaaatacaagaatttgaacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaagacctttgaagacaatttaattgaagcaaggaaagaagttgaagtatcacagagtaaatacaatgctctatcattacagttgagtaataaacagactgaacttatccagaaggatatggatattaccctggtcaggaaggaactgcaggagctgcagaatctttacaaacagaacagtacacatacagcccagcaagcagagctgatccagcagcttcaggttctcaatatggacacacaaaaagtactgagaaatcaggaagatgttcacacagctgaaagtatatcatatcaaaaagtatgcttttattctgtaataaagatgtaaatgtttatgtatgaacttatgaacatatatagaattcagattttttcaaatttcagcatttaatttttacttccttttacatgtgtttcctcaaaatttagaagtgaaggatggttcaatttgataacatttaaaattttttgaattttctttatggtaattagagctgaatcacttaaaatatagatacaaacttactctatagggtattatttttataaattggcattcagacagcttctgtgaaacatactaggagtatagtctcaaaactggaatggaattcctcggcctgctattacaagaaattattttgtcaagtatggcagactttcattgtaaaatttgtacattatttttcggcaaatcttcacaaatacaaaggggattgctgaggagggctttaggatcaatattttccaggatttttctctgtttattttgtgtgtttctgttcagtagtcttttactttacagttgttttaggagcctttcaagaaggtttacccaagtatttaggtgtgctaactgactcagcagcaataatttaatctactaattaaaaaaaatacctttattggccgggcatggtggctcatgcctgtaatcccagcactttgggaggctgaggcgggcgaatcacaaggtcaagagatcgagaccatcctggccaacatgatgaaaccctgtttctactaaaaatacaaaaagttagctgagcatggtggttcatgcctgtagtcccagctacttgggaggctgaggcaggagaatcacttgaacctgggaggcggaggtcgcagtgagccaagatcgcaccattgcactccagccaggcgacagggggagacaacgtctc

SEQ ID NO: 5366 - DNA, 5576 bp, Homo sapiens
cggttcggcgttccgggctcgccgggttggggaaagggaggtggagtttccaacagggaacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggctgataaagaatttgtatggtctttgtggaaacgtctccaggttacaaacccagatctcacacaagtggtcagtttggttgtggaaagagaaaaacagaaatctgaagctaaagacagaaaagttctagaaattctgcaagtcaaggatgccaaaatacaagaatttgaacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaagacctttgaagacaatttaattgaagcaaggaaagaagttgaagtatcacagagtaaatacaatgctctatcattacagttgagtaataaacagactgaacttatccagaaggatatggatattaccctggtcaggaaggaactgcaggagctgcagaatctttacaaacagaacagtacacatacagcccagcaagcagagctgatccagcagcttcaggttctcaatatggacacacaaaaagtactgagaaatcaggaagatgttcacacagctgaaagtatatcatatcaaaaactttacaatgagttacatatttgttttgaaaccacaaaatcaaatgaagctatgctccggcaaagtgttactaatcttcaggatcagctattacaaaaagagcaagaaaatgctaagttaaaagaaaaacttcaggaatcacagggagcacctcttcctttacctcaagaaagtgatccagactactcagcacaggtacctcatcgcccatccttatcaagcttagaaacgttaatggtttcacagaagtctgaaattgagtatttacaggagaaactaaagatagcaaatgaaaaactgtcagaaaacatatctgccaacaagggtttctcccgaaagagcatcatgacaagtgctgaaggaaaacataaggaaccacctgtgaaacgttcaaggtctttgtccccaaagagctctttcacagactcagaagagctacagaagctgagaaaagctgaaagaaagattgaaaacttagagaaggcactacaactaaagagccaagaaaatgatgagctaagagatgcccatgaaaaacgcaaggaacggctacagatgttacagaccaactacagagcagtaaaagagcaattaaaacagtgggaagaaggcagtggcatgactgaaatcaggaaaataaagagagcagatccccaacaacttcgacaagaagattctgacgctgtgtggaatgaactggcatatttcaaaagggaaaaccaggagctaatgattcaaaagatgaatcttgaagaagaattagatgaacttaaagtacatatatctattgataaggcagcaatacaagaattgaatagatgtgtggcagagagaagagaagaacagctctttagatctggtgaagatgatgaggtcaagaggagtactccagagaagaatggaaaagaaatgttggagcagacattacagaaggtcactgagttggaaaatcggctgaaatcttttgagaaaaggtcgagaaaattaaaagaagggaataaaaaattaatgaaagaaaatgattttctgaaatccctcttaaaacagcaacaagaagatacagagaccagagaaaaagagctagaacagataataaaggggagtaaagatgtagaaaaagaaaatactgaacttcaagtaaaaatcagtgagctggagacagaagtcacttccctgaggagacaagtggcagaagctaatgcattgagaaatgaaaatgaagagctgatcaacccaatggagaaatcacaccagtcagcagacagagctaaatccgagatggccaccatgaaagtgagatctggacgatatgattgtaagacaactatgaccaaggttaaatttaaagctgcgaagaaaaattgctctgtgggtcgtcaccacactgttctcaatcattccatcaaggttatgagcaatgtgtttgagaacctcagcaaggacggctgggaggatgtgagtgaaagcagcagtgattctgaagcacagacctctcaaactttgggaacaattattgtagaaacatcccagaaaataagtcctacggaagatggaaaagaccagaaagaaagtgatccaacagaagacagccaaacacaaggaaaagaaatagtacagacatatttaaatatagatggcaagaccccaaaggactattttcatgataagaatgccaaaaaaccaacttttcaaaagaagaattgcaagatgcaaaagagttcacatacagcagttcctactagagtcaacagagaaaagtacaaaaatataactgcccagaaatcaagtagcaatattattttattacgagaacggattatatccttgcaacaacaaaacagtgtacttcagaatgccaagaaaacagcagaattgtctgttaaagaatataaagaagttaatgaaaagctcctccatcaacagcaagtatccgatcaacgatttcagacaagcaggcagacaataaagaagctaaatttggatttggctgggcttcggaaagaaaaagaagatttactaaagaaattggagtcctcatctgaaatcacaagtttggcagaagaaaattcccaggtaacatttccacggatacaagttacatcacttagtccttcaaggagcatggatttggaaatgaagcaattgcagtataaactaaagaatgctactaatgaactcactaaacagtcatcaaatgtgaagactttgaaatttgaactcctagcaaaagaagaacacataaaggaaatgcatgaaaagatatctcgaatggagagggatataactatgaaaagacatttgatagaggacttgaaatttcgacagaaagtaaatttggaaagtaacaagagttttagtgaaatgttacaaaatcttgataaaaaggtaaagacattaactgaagaatgttccaacaagaaggtatcaattgattcactaaagcaaagacttaacgttgctgtaaaagaaaagtcacagtatgaacagatgtatcagaaatctaaagaggagttagaaaaaaaggatctcaagcttactctcctagtatcaagaataagtgagactgaatctgcaatggcagaaattgaaacagcagcatctaagcagcttcaagaattagcattgcaaagtgaacaggtcctagaaggtgcacagaagacattgctgttagccaatgaaaaagtagaagagttcaccacatttgtgaaggctttggccaaagagttgcaaaatgatgtccatgtggtaaggcgacaaataagagagcttaaaaaaatgaagaaaaacagggacgcctgtaaaacctcaacccataaagcccagaccttggcagcttctatcctgaacatttcacggtcagatttagaggaaatattagacacagaagatcaagtggaaattgaaaaaacaaaaattgatgctgaaaatgacaaggaatggatgttgtacattcagaaacttcttgaaggacagcttccttttgcctcatatttactagaagcagtactggaaaaaataaatgaaaaaaagaaactagttgaaggatatttcacaattatgaaagatattagatgatattaaaatggagagctttattgcaaatgtgaaaactttttatgtggtgtgattggaatacatgcattgcaatcctgacacggtatctgctccaactatcaatagtcaggttcaataccaaaataagaagtctctgaaaataattaattgctgaacaagtgaaactaattaagtacatagccatttaaaaggaaatagtgtagcatctgatggtcgaatacaaatattgccacaaatcagtgcaaacttaaaaatgattttccttctagtgcattaaaagaaactgagcaggcttggtacacacaaattggcctgagcataagaagaaaaagtatcaactaaggatttaatgttttacgtttcatgaagaaactagactttttacataaaactgctatagatggccataagtggtccagggagcaacagatttgtagtatgagcaaatataaaatgaagcatcataacttgagcatttattgaaataaattgtgtggtccaattgaatctgttctcattgatgtgctggtttatgtaggagatactgtgtatttctacaactctttggcaaaaacaaaaacattttcttcttctctctcttaacttcacaatactatacgttgtgtagtcatataaatttgcagggaaccacaaacccaatgtataaaattaggctctatttaacagaactactactgtggtcagctaatttaagttacattcttaaccatgatgtcatccttatttagattcctggacattcccacctcatttcacctcttcaccgtgttcctgccataccctttttggttcctctaattcaccatactggtgcctgcctcccacatttgcccttggtcttctctctttctagaatactctgcactcaactttcctcatggctggctccttgtcatcattcagctccaccttccccggtccctcagagacacattctctgaccagcttactattttatttcctcatagcacaaaattatctatctgttcatgtatttgttttcttgtttattttcttcttttccctctttagtatgtaggtcccatgagattaaggcaagggttggcagattatagcctgcagggcgaatctggcctgccacctgttttgtatggcccacaagctaagaatggtttttgccttattaaatggtttttaaaaaatcaaaaggagaataatattttgtagcatgtgaaaattatataaaattcaaattttggtgtctgttaataaagttttattggaacaca

SEQ ID NO: 5367 - DNA, 5516 bp, Homo sapiens
agggaacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggctgataaagaatttgtatggtctttgtggaaacgtctccaggttacaaacccagatctcacacaagtggtcagtttggttgtggaaagagaaaaacagaaatctgaagctaaagacagaaaagttctagaaattctgcaagtcaaggatgccaaaatacaagaatttgaacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaagacctttgaagacaatttaattgaagcaaggaaagaagttgaagtatcacagagtaaatacaatgctctatcattacagttgagtaataaacagactgaacttatccagaaggatatggatattaccctggtcaggcaagaactgcaggagctgcagaatctttacaaacagaacagtacacatacagcccagcaagcagagctgatccagcagcttcaggttctcaatatggacacacaaaaagtactgagaaatcaggaagatgttcacacagctgaaagtatatcatatcaaaaactttacaatgagttacatatttgttttgaaaccacaaaatcaaatgaagctatgctccggcaaagtgttactaatcttcaggatcagctattacaaaaagagcaagaaaatgctaagttaaaagaaaaacttcaggaatcacagggagcacctcttcctttacctcaagaaagtgatccagactactcagcacaggtacctcatcgcccatccttatcaagcttagaaacgttaatggtttcacagaagtctgaaattgagtatttacaggagaaactaaagatagcaaatgaaaaactgtcagaaaacatatctgccaacaagggtttctcccgaaagagcatcatgacaagtgctgaaggaaaacataaggaaccacctgtgaaacgttcaaggtctttgtccccaaagagctctttcacagactcagaagagctacagaagctgagaaaagctgaaagaaagattgaaaacttagagaaggcactacaactaaagagccaagaaaatgatgagctaagagatgcccatgaaaaacgcaaggaacggctacagatgttacagaccaactacagagcagtaaaagagcaattaaaacagtgggaagaaggcagtggcatgactgaaatcaggaaaataaagagagcagatccccaacaacttcgacaagaagattctgacgctgtgtggaatgaactggcatatttcaaaagggaaaaccaggagctaatgattcaaaagatgaatcttgaagaagaattagatgaacttaaagtacatatatctattgataaggcagcaatacaagaattgaatagatgtgtggcagagagaagagaagaacagctctttagatctggtgaagatgatgaggtcaagaggagtactccagagaagaatggaaaagaaatgttggagcagacattacagaaggtcactgagttggaaaatcggctgaaatcttttgagaaaaggtcgagaaaattaaaagaagggaataaaaaattaatgaaagaaaatgattttctgaaatccctcttaaaacagcaacaagaagatacagagaccagagaaaaagagctagaacagataataaaggggagtaaagatgtagaaaaagaaaatactgaacttcaagtaaaaatcagtgagctggagacagaagtcacttccctgaggagacaagtggcagaagctaatgcattgagaaatgaaaatgaagagctgatcaacccaatggagaaatcacaccagtcagcagacagagctaaatccgagatggccaccatgaaagtgagatctggacgatatgattgtaagacaactatgaccaaggttaaatttaaagctgcgaagaaaaattgctctgtgggtcgtcaccacactgttctcaatcattccatcaaggttatgagcaatgtgtttgagaacctcagcaaggacggctgggaggatgtgagtgaaagcagcagtgattctgaagcacagacctctcaaactttgggaacaattattgtagaaacatcccagaaaataagtcctacggaagatggaaaagaccagaaagaaagtgatccaacagaagacagccaaacacaaggaaaagaaatagtacagacatatttaaatatagatggcaagaccccaaaggactattttcatgataagaatgccaaaaaaccaacttttcaaaagaagaattgcaagatgcaaaagagttcacatacagcagttcctactagagtcaacagagaaaagtacaaaaatataactgcccagaaatcaagtagcaatattattttattacgagaacggattatatccttgcaacaacaaaacagtgtacttcagaatgccaagaaaacagcagaattgtctgttaaagaatataaagaagttaatgaaaagctcctccatcaacagcaagtatccgatcaacgatttcagacaagcaggcagacaataaagaagctaaatttggatttggctgggcttcggaaagaaaaagaagatttactaaagaaattggagtcctcatctgaaatcacaagtttggcagaagaaaattcccaggtaacatttccacggatacaagttacatcacttagtccttcaaggagcatggatttggaaatgaagcaattgcagtataaactaaagaatgctactaatgaactcactaaacagtcatcaaatgtgaagactttgaaatttgaactcctagcaaaagaagaacacataaaggaaatgcatgaaaagatatctcgaatggagagggatataactatgaaaagacatttgatagaggacttgaaatttcgacagaaagtaaatttggaaagtaacaagagttttagtgaaatgttacaaaatcttgataaaaaggtaaagacattaactgaagaatgttccaacaagaaggtatcaattgattcactaaagcaaagacttaacgttgctgtaaaagaaaagtcacagtatgaacagatgtatcagaaatctaaagaggagttagaaaaaaaggatctcaagcttactctcctagtatcaagaataagtgagactgaatctgcaatggcagaaattgaaacagcagcatctaagcagcttcaagaattagcattgcaaagtgaacaggtcctagaaggtgcacagaagacattgctgttagccaatgaaaaagtagaagagttcaccacatttgtgaaggctttggccaaagagttgcaaaatgatgtccatgtggtaaggcgacaaataagagagcttaaaaaaatgaagaaaaacagggacgcctgtaaaacctcaacccataaagcccagaccttggcagcttctatcctgaacatttcacggtcagatttagaggaaatattagacacagaagatcaagtggaaattgaaaaaacaaaaattgatgctgaaaatgacaaggaatggatgttgtacattcagaaacttcttgaaggacagcttccttttgcctcatatttactagaagcagtactggaaaaaataaatgaaaaaaagaaactagttgaaggatatttcacaattatgaaagatattagatgatattaaaatggagagctttattgcaaatgtgaaaactttttatgtggtgtgattggaatacatgcattgcaatcctgacacggtatctgctccaactatcaatagtcaggttcaataccaaaataagaagtctctgaaaataattaattgctgaacaagtgaaactaattaagtacatagccatttaaaaggaaatagtgtagcatctgatggtcgaatacaaatattgccacaaatcagtgcaaacttaaaaatgattttccttctagtgcattaaaagaaactgagcaggcttggtacacacaaattggcctgagcataagaagaaaaagtatcaactaaggatttaatgttttacgtttcatgaagaaactagactttttacataaaactgctatagatggccataagtggtccagggagcaacagatttgtagtatgagcaaatataaaatgaagcatcataacttgagcatttattgaaataaattgtgtggtccaattgaatctgttctcattgatgtgctggtttatgtaggagatactgtgtatttctacaactctttggcaaaaacaaaaacattttcttcttctctctcttaacttcacaatactatacgttgtgtagtcatataaatttgcagggaaccacaaacccaatgtataaaattaggctctatttaacagaactactactgtggtcagctaatttaagttacattcttaaccatgatgtcatccttatttagattcctggacattcccacctcatttcacctcttcaccgtgttcctgccataccctttttggttcctctaattcaccatactggtgcctgcctcccacatttgcccttggtcttctctctttctagaatactctgcactcaactttcctcatggctggctccttgtcatcattcagctccaccttccccggtccctcagagacacattctctgaccagcttactattttatttcctcatagcacaaaattatctatctgttcatgtatttgttttcttgtttattttcttcttttccctctttagtatgtaggtcccatgagattaaggcaagggttggcagattatagcctgcagggcgaatctggcctgccacctgttttgtatggcccacaagctaagaatggtttttgccttattaaatggtttttaaaaaatcaaaaggagaataatattttgtagcatgtgaaaattatataaaattcaaattttggtgtctgttaataaagttttattgg

SEQ ID NO: 5368 - DNA, 1158 bp, Homo sapiens
gcggggcggtgccgttgggaccacggcggccagagcggcaggatggcttccggcttcaagaagcccagcgctgcctccaccggccaaaagagaaaggtggcacctaagcccgagctcactgaggatcagaagcaagaagttcgggaagcatttgacctcttcgacgtggacggaagtgggaccatcgacgcgaaggagctgaaggtggccatgagagcgctgggcttcgaacccaggaaggaagagatgaagaaaatgatctccgaggtggacagggaaggcacggggaagatcagcttcaatgacttcctggccgtgatgacgcagaagatgtccgagaaggacaccaaagaagaaatcctgaaggccttcaggctctttgatgacgatgagaccgggaagatctcgttcaaaaacctgaagcgtgtggccaacgagctgggggagaacctcacggatgaggagctgcaggagatgatcgacgaagctgatcgggatggggacggcgaagtgaacgaggaggagttccttcggatcatgaagaagaccagcctttactgaagtcggttcagaagctaaagtgactctctgggttgcctgcttccattttgtgaaaccttagaggacagcggctgcctgtcccttcttcaccccctcacccccataatttgtctagatctatttccatatctctagttcaataatagaatttgaaagatgcttgtaatgtgagttttgggttttaattctcaagagtcaacctggagcacatgaggttaaacaaagggccctgaagtttgagtgcgccctccatttgccctgtgctgaacttgctgttcatctgttgatctggaggcaggacagcttctgggacacacaaaaatgtggttccctttgtcacttctttggtggtcttaaattatcttgcttcatatatcattccttaaattccagtcattgttccagcataatgagatggaatctgccagtagatttgcctagcctgtccacttagctgaataccagtttgaaggaaaacagggtggccacttacaaacttacggagctcaggacagataatcttataaagaatagacttgcttgggtggtagtacgttgtgcaattttgactattcactggctttatacctgcaaatg

SEQ ID NO: 5369 - DNA, 1454 bp, Homo sapiens
ggtgggaacggcgccgagtcagtgtacacgtcggttgcctaacaaccggcagcggactcctttggctatggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggaaatgattgatgaagctgatcgagatggagatggagaggtcagtgagcaagagttcctgcgcatcatgaaaaagaccagcctctattaagatcagtgtcttctttttctactgcaagcacatgtaactagatttagtgcctgccatggtgtgaaatctggcttttgagaacacaaacttttcccccacggacctccctttatcactttaatagtgaccttgagcctattttagccgtttggaagtgttctttgatattacagttctttgtaaaatgacctgcgaattaccctaattctcaaaagcaaaacaagagcacacaagcgtgaagaaaaggatcttaaagctttgagcacctgccattttgccttgcatcgtttccctcgtcatgcatttccacatatccacaaacacagaacgactttagacaagcacatgttacacctgtgttgccacaagcagtcattcttgacggctccagtttttatttgacacttgagtttagttttctcttttataaacccagtgaactcctgcactggcatttggatgtgtgttaatgctatttgttttgtcttaaaagtaaaacctttctcagtttgaacttgtattctctaaggatgagttctttagctttgcttatgagttcctcttctcaattattgtgttgaaggcagcctattagatacaaaactccttaccagcctatggacagaaaatgaataatcctttgctactttcctggcatgaattgctttttgccttggaaggctgctggtttgtaaaactagcagaatttttatatcacctaagcctaaatgatgctctaaaaatagttttggcaaagctaagactggaaaagagtcttgttagtaatttgtgcttgaataaaatggggagagccaggctaacgcaacactaggatggattcagccaacctctcgtgaatttatttgct

SEQ ID NO: 5370 - DNA, 1299 bp, Homo sapiens
agcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggctatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatgaaaa

SEQ ID NO: 5371 - DNA, 1452 bp, Homo sapiens
gttttaaaaaacgccggccgtgaagtgggcggagcgagcgatttgaacgcgagcggcgcggacttctgccaagcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcaagagaaatatgtgttaaattcactcgtggtgtggacttcaattggcaagcccaggccctattggccctacaagaggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggctatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatgaaaatgga

SEQ ID NO: 5372 - DNA, 2840 bp, Homo sapiens
gcccgccgcccggcgacgcgcccgccggcgtccccggaggtgcccccggcccggccgggtcgtcgccccgccgccgcgcccgcgagccgctttgtctcgggcggggcgcgcgggagaggccgccaggtgccccccgccacgggcccgggccccccgccccggggcggcggcggcggcgccgggccccggggcggggggcgcgccgggatgggccccaagaggcgacagctgacgttccgggagaagtcacggatcatccaggaggtggaggagaatccggacctgcgcaagggcgagatcgcgcggcgcttcaacatcccgccgtccacgctgagcacgatcctgaagaacaagcgcgccatcctggcgtcggagcgcaagtacggggtggcctccacctgccgcaagaccaacaagctgtctccctacgacaagctcgagggcttgctcatcgcctggttccagcagatccgcgccgccggcctgccggtcaagggcatcatcctcaaggagaaggcgctgcgcatagccgaggagctgggcatggacgacttcaccgcctccaacggctggctggaccgcttccgccggcgccacggcgtggtgtcctgcagcggcgtggcccgcgcccgcgcgcgaaacgctgccccccgcaccccggcggcgcctgccagtccggccgcggtgccctcggagggcagtggcgggagcactactggttggcgcgctcgggaggagcagccgccgtcggtggccgagggctacgcctcgcaggacgtgttcagcgccaccgagaccagtctatggtacgacttcctgcccgaccaggccgcggggctgtgcggaggcgacggacggccgcgtcaagccacccagcgcctgagcgtcctgctatgcgccaatgccgacggcagcgagaagctgcccccgctggtggccggcaagtcggccaagccccgcgcaggccaagccggcctgccctgcgactacaccgccaactccaagggtggtgtcaccacccaggccctggccaagtacttgaaggccttggacacccgaatggctgcagagtctcgccgggtcctgctgttggccggccgcttggctgcccagtccttggacacctcgggcctgcggcatgtgcagctggccttcttccctcccggcaccgtgcatccgctggagaggggagtggtccagcaggtgaagggccactaccgccaggccatgctgctcaaggccatggccgcgctagagggccaggatccctcaggcctgcagctgggtctcacggaggccctgcactttgtggctgccgcctggcaggcagtggagccttcggacatagccgcctgctttcgtgaggctggctttgggggtggccctaatgccaccatcaccacttccctcaagagtgagggagaggaagaggaggaggaggaggaagaagaggaggaggaagagggtgaaggagaggaagaggaggaggaaggggaggaggaggaggaggaagggggggaaggagaggaattgggggaggaagaggaggtggaggaggagggtgatgttgatagtgatgaagaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggtcagcctcactgcctgcttattgcctctttctcagaatcctctttcctccccatttggccctgggctcaggggaccaggtggggcgggtggggagctgtccggtgctaccacaccgtgccctcagtggactaaccacagcagcagccagggatgggccctggaggttcccggccggagagtgcctctcccctctgccatccacgtcaggtctttggtggggggaccccaaagccattctgggaagggctccagaagaaggtccagcctaggccccctgcaaggctggcagcccccacccccaccccccaggccgccttgagaagcacagtttaactcactgcgggctcctgagcctgcttctgcctgctttccacctccccagtccctttctctggccctgtccatgtgactttggcccttggttttctttccagattggaggtttccaagaggccccccaccgtggaagtaaccaagggcgcttccttgtgggcagctgcaggccccatgcctctcctccctctctggcagggccccatcctgggcagaggggcctggggctgggcccagagtccagccgtccagctgctcctttcccagtttgatttcaataaatctgtccactccccttttgtgggggtgaacgttttaacagccaa

SEQ ID NO: 5373 - DNA, 709 bp, Homo sapiens
gaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgagattggaggtttccaagaggccccccaccgtggaagtaaccaagggcgcttccttgtgggcagctgcaggccccatgcctctcctccctctctggcagggccccatcctgggcagagg

SEQ ID NO: 5374 - DNA, 3885 bp, Homo sapiens
atgtgtctccgggttcaaacccaggcacaggccaagcgttcttgtttgttgagggcggagccaatggcgggggagtgttgttagcgcgcgccttccggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgcccaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactccttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcgctgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaaagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtgaaaaacagtttgtatagttggaatatttgtctttgtaattacttgtgatgttttaaaataaaaattttattcagttttctgtagacttgtatttgataaacatttctaactcacatgttttttctgatttttcagtgactgtacataatagcttgtagcgatgtccatatttatgatattatttttataatttgacaagaatatgaaaatgaaatatagaacatttctgtgtcaaaagagacctgattaatatgtctactcattaaaaaacatcttttccaaatactaattttaaatcatttattattaaataatccaatgggagagaactgtggtaaaaggcatgtttgtattaatttcctagaactgctgtaacaaaataccacaaaatgagtgacttaaagcaacagaaatttattatctcagttctagaggctagaagtctgaaatcaaggtgttgtcaaggccgtgatgtctttgaaaacctgtaagggagagaatccttccttattcctaacttctggtggtttactggcaatttctggcattccttggcttgcaccggtagcatttcaatctacttgcattatcacatggtattctcaccttgtgtgtctgtgttggcatgacatctatttagtatattacatgtaaatgtttttccattatgctttttggttcatattttctgttggaggcagtgtccttcgccattgctttctgtatgtggcctcaactttccctttttaatatcaat

SEQ ID NO: 5375 - DNA, 8612 bp, Homo sapiens
taaatttaaaggcggggcggcctgtgagccctgaagtgccggccgcggagggtcctggccattttcctgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagatgcaactaattcatgaaatttcgaacttaaagaatttagttaagcatgcagaagtatataatcaagatcttgagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagctgaaggagaaaatgaaagaacttgcaactacatacaagcaaatggaaaatgatattcagttatatcaaagccagttggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctacgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaagaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagatccaagaacttcagaaaaaagaacttcaactgcttagagtgaaagaagatgtcaatatgagtcataaaaaaattaatgaaatggaacagttgaagaagcaatttgaggcccaaaacttatctatgcaaagtgtgagaatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagagaccgacagaaccaccaagtaaaacctgaaaaaaggttactaagtgatggacaacagcaccttacggaaagcctgagagaaaagtgctctagaataaaagagcttttgaagagatactcagagatggatgatcattatgagtgcttgaatagattgtctcttgacttggagaaggaaattgaattccaaaaagagctttcaatgagagttaaagcaaacctctcacttccctatttacaaaccaaacacattgaaaaactttttactgcaaaccagagatgctccatggaattccacagaatcatgaagaaactgaagtatgtgttaagctatgttacaaaaataaaagaagaacaacatgaatccatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctgaatcacc

SEQ ID NO: 5376 - DNA, 8241 bp, Homo sapiens
aaatttaaaggcggggcggcctgtgagccctgaagtgccggccgcggagggtcctggccattttcctgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagctgaaggagaaaatgaaagaacttgcaactacatacaagcaaatggaaaatgatattcagttatatcaaagccagttggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctacgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaagaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagcaggaccgacagaaccaccaagtaaaacctgaaaaaaggttactaagtgatggacaacagcaccttacggaaagcctgagagaaaagtgctctagaataaaagagcttttgaagagatactcagagatggatgatcattatgagtgcttgaatagattgtctcttgacttggagaaggaaattgaattccaaaaagagctttcaatgagagttaaagcaaacctctcacttccctatttacaaaccaaacacattgaaaaactttttactgcaaaccagagatgctccatggaattccacagaatcatgaagaaactgaagtatgtgttaagctatgttacaaaaataaaagaagaacaacatgaatccatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctg

SEQ ID NO: 5377 - DNA, 8504 bp, Homo sapiens
taaatttaaaggcggggcggcctgtgagccctgaagtgccggccgcggagggtcctggccattttcctgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagatgcaactaattcatgaaatttcgaacttaaagaatttagttaagcatgcagaagtatataatcaagatcttgagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagctgaaggagaaaatgaaagaacttgcaactacatacaagcaaatggaaaatgatattcagttatatcaaagccagttggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctacgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaagaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagatccaagaacttcagaaaaaagaacttcaactgcttagagtgaaagaagatgtcaatatgagtcataaaaaaattaatgaaatggaacagttgaagaagcaatttgaggcccaaaacttatctatgcaaagtgtgagaatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagagaccgacagaaccaccaagtaaaacctgaaaaaaggttactaagtgatggacaacagcaccttacggaaagcctgagagaaaagtgctctagaataaaagagcttttgaagagatactcagagatggatgatcattatgagtgcttgaatagattgtctcttgacttggagaaggaaattgaattccacagaatcatgaagaaactgaagtatgtgttaagctatgttacaaaaataaaagaagaacaacatgaatccatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctgaatcacc

SEQ ID NO: 5378 - DNA, 10307 bp, Homo sapiens
agaagcgggcgaattgggcaccggtggcggctgcgggcagtttgaattagactctgggctccagcccgccgaagccgcgccagaactgtactctccgagaggtcgttttcccgtccccgagagcaagtttatttacaaatgttggagtaataaagaaggcagaacaaaatgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctgcgctgcagaagcaaaaacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaacaagaggtgactccaagtcgatcaactttgcaaatagggaaaagagatgctaatagcagtttctttgacaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctctaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaaaatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtagaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaacggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatatcacaatctctgtttgtatgtgggttttacactaaaaaaatgcaaaacacattttattcttctaattaacagctcctaggaaaatgtagacttttgctttatgatattctatctgtagtatgaggcatggaatagttttgtatcgggaatttctcagagctgagtaaaatgaaggaaaagcatgttatgtgtttttaaggaaaatgtgcacacatatacatgtaggagtgtttatctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaagaatgattcctaagtgt

SEQ ID NO: 5379 - DNA, 525 bp, Homo sapiens
ttgatgattaaaggaagaaaaggtaaggtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaaggaaaat

SEQ ID NO: 5380 - DNA, 4347 bp, Homo sapiens
aggacctcgggacgggggcggggctccgacagaggcggcgattgtggcggcccatttgtaaatgctgcggagattgaggtgtcggttcgtgctgctgagctgcccaggcttcacggagcggtgttggaaatcaatagctcttctagcctttgcattgtttaaatataatagtgtcattggactaagatgttcctgatgccaacctcttcagagttaaacagtgggcagaacttcctaacccagtggatgaccaatccttctcgggctggggtcatattaaatcgtggatttcctattttggaagcagacaaagagaagcgagcagctgtggacatttctaccagctttcctattaaaggcacacatttttctgatagcttcagctttataaatgaagaagattcacttcttgaagaacagaagttggagtcaaacaacccttacaaaccacagtcagataaatctgaaacccatacagcctttccttgcattaaaaagggaccacaggtagcggcatgtcacagtgctcctggacaccaggaagaaaacaaaaatgacttcatcccagatcttgcgagtgaattcaaagaaggggcttataaagacccactttttaaaaaacttgaacagctgaaagaagtacaacagaagaagcaggaacaattgaagaggcaacagttggagcaactacagagactcatggaagaacaagagaagctgctcaccatggtgtctgggcagtgcacacttccaggtttgagtttactgcctgatgatcagagccagaagcacaggtctccaggaaataccaccactggagagagagccacatgctgcttcccatcatatgtctacccggacccaacccaggaagaaacatacccgtccaacattttatcccatgagcaaagcaacttctgtagaactgctcatggagattttgtcttaacttcaaaacgtgcgtctcctaatttattttctgaggcacagtatcaagaagcacctgtggaaaaaaataatttaaaagaagaaaaccgtaaccatcctacaggagaaagtatcttatgttgggagaaagtgacagaacagattcaggaagcaaatgataagaacttacaaaaacatgatgattcctcagaagtggctaatattgaagaaaggcccattaaagctgctattggagaaaggaaacagacctttgaagattacttagaagaacaaattcagttggaagagcaagaactgaagcaaaaacagctgaaggaagcagaaggaccattgccaatcaaagcaaaaccaaaacaaccatttttaaaacgaggagaaggtttagctagatttactaatgccaaatctaagtttcaaaaaggcaaagaaagtaaactagtgactaaccagagcacttccgaggaccagccgctgtttaaaatggatagacagcaactccagcggaaaaccgctcttaaaaataaagagctgtgtgcagacaaccctatccttaaaaaggacagtaaagctagaaccaagagtggttctgtcaccctcagtcagaagccgaaaatgctgaagtgtagtaacaggaaaagtctttctccgtcaggattgaaaatacagacggggaagaaatgtgatgggcagtttagagaccagatcaaatttgaaaacaaagtcacatctaataataaagaaaatgtaactgagtgtccaaaaccttgcgatactggctgcacagggtggaataagacacaaggtaaagacagacttcctctttcaacagggccggccagccggctggctgctaagagccccataagggagaccatgaaagagtctgaatcttctcttgacgtttctcttcagaaaaagttagagacttgggaacgagaaaaggaaaaggaaaatttggaattagatgaatttttgtttttagaacaagctgctgatgaaatatcattttctagtaattcctcatttgtactgaaaatcttagaaagggatcaacagatctgcaaaggtcaccggatgtcttccacccctgtcaaagctgtgccacagaagacaaatccggcagatcccattagtcattgtaaccgcagtgaggatttggaccacactgcacgtgagaaggagagtgagtgtgaagtcgcacccaaacaacttcattcattgtcctcagctgatgaattgagggaacagccttgtaaaatcaggaaagccgtccaaaagagcacttctgaaaatcagactgaatggaatgcacgtgacgatgaaggtgttccaaatagtgacagtagcactgactctgaggaacagcttgatgttaccataaaaccatcgactgaggatagagagaggggcatcagcagcagagaggatagcccacaagtctgtgatgataaggggccttttaaggacaccaggacccaagaagataaaaggagagatgttgatctggatttgtctgataaagattacagtagcgatgagtctatcatggaaagcataaaacataaagtgtctgagccctcgagatcctcatccctaagtctgagtaaaatggactttgatgatgaaagaacttggactgaccttgaagagaatttgtgtaaccatgatgttgttcttgggaatgaatccacttatgggacgccgcagacatgctaccctaataatgaaataggtatcctggacaaaacaataaaaaggaagattgcaccagtcaagaggggagaagacttgagcaagtccaggaggagcagaagtcctcctacatcggagctgatgatgaaattctttccttctttgaaaccaaaaccaaagtcagattcacacttgggaaatgaactcaagttaaacataagtcaagaccaaccacctggtgacaatgctcgatcccaggttttgagagagaaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacagactttaaaacagcaaatagcagatttacgggaagatttgaaaagaaaggaaaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaaaacagtcagatttcttcaggaacccaggtagaaaaatacaagaaaaattatcttccaatgcaaggcaatccacctcgaagatccaagtctgcacctcctcgtgatttaggcaatttggataagggacaagctgcctctcccagggagccacttgaaccactgaacttcccagatcctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtgatctactactatgcagctgcccagaccactcacacgacatacccggagggactggaagtcttacatttctcaagtggacaaatagaaaaacattacccagatggaagaaaagaaatcacgtttcctgaccagactgttaaaaacttatttcctgatggacaagaagaaagcattttcccagatggtacaattgtcagagtacaacgtgatggcaacaaactcatagagtttaataatggccaaagagaactacatactgcccagttcaagagacgggaatacccagatggcactgttaaaaccgtatatgcaaacggtcatcaagaaacgaagtacagatccggtcggataagagttaaggacaaggagggtaatgtgctaatggacacggagctgtgacgatcctcatgtgatcatgaagtaacagtaactgactttttatgttaaaaaatgtacatttactgtggattctgtttaatttattgtgtatgtgtggggaaaagattagattctaaaataaaagtttaccctgtggcatcttca

SEQ ID NO: 5381 - DNA, 4299 bp, Homo sapiens
agattgaggtgtcggttcgtgctgctgagctgcccaggcttcacggagcggtgttggaaatcaatagctcttctagcctttgcattgtttaaatataatagtgtcattggactaagatgttcctgatgccaacctcttcagagttaaacagtgggcagaacttcctaacccagtggatgaccaatccttctcgggctggggtcatattaaatcgtggatttcctattttggaagcagacaaagagaagcgagcagctgtggacatttctaccagctttcctattaaaggcacacatttttctgatagcttcagctttataaatgaagaagattcacttcttgaagaacagaagttggagtcaaacaacccttacaaaccacagtcagataaatctgaaacccatacagcctttccttgcattaaaaagggaccacaggtagcggcatgtcacagtgctcctggacaccaggaagaaaacaaaaatgacttcatcccagatcttgcgagtgaattcaaagaaggggcttataaagacccactttttaaaaaacttgaacagctgaaagaagtacaacagaagaagcaggaacaattgaagaggcaacagttggagcaactacagagactcatggaagaacaagagaagctgctcaccatggtgtctgggcagtgcacacttccaggtttgagtttactgcctgatgatcagagccagaagcacaggtctccaggaaataccaccactggagagagagccacatgctgcttcccatcatatgtctacccggacccaacccaggaagaaacatacccgtccaacattttatcccatgagcaaagcaacttctgtagaactgctcatggagattttgtcttaacttcaaaacgtgcgtctcctaatttattttctgaggcacagtatcaagaagcacctgtggaaaaaaataatttaaaagaagaaaaccgtaaccatcctacaggagaaagtatcttatgttgggagaaagtgacagaacagattcaggaagcaaatgataagaacttacaaaaacatgatgattcctcagaagtggctaatattgaagaaaggcccattaaagctgctattggagaaaggaaacagacctttgaagattacttagaagaacaaattcagttggaagagcaagaactgaagcaaaaacagctgaaggaagcagaaggaccattgccaatcaaagcaaaaccaaaacaaccatttttaaaacgaggagaaggtttagctagatttactaatgccaaatctaagtttcaaaaaggcaaagaaagtaaactagtgactaaccagagcacttccgaggaccagccgctgtttaaaatggatagacagcaactccagcggaaaaccgctcttaaaaataaagagctgtgtgcagacaaccctatccttaaaaaggacagtaaagctagaaccaagagtggttctgtcaccctcagtcagaagccgaaaatgctgaagtgtagtaacaggaaaagtctttctccgtcaggattgaaaatacagacggggaagaaatgtgatgggcagtttagagaccagatcaaatttgaaaacaaagtcacatctaataataaagaaaatgtaactgagtgtccaaaaccttgcgatactggctgcacagggtggaataagacacaaggtaaagacagacttcctctttcaacagggccggccagccggctggctgctaagagccccataagggagaccatgaaagagtctgaatcttctcttgacgtttctcttcagaaaaagttagagacttgggaacgagaaaaggaaaaggaaaatttggaattagatgaatttttgtttttagaacaagctgctgatgaaatatcattttctagtaattcctcatttgtactgaaaatcttagaaagggatcaacagatctgcaaaggtcaccggatgtcttccacccctgtcaaagctgtgccacagaagacaaatccggcagatcccattagtcattgtaaccgcagtgaggatttggaccacactgcacgtgagaaggagagtgagtgtgaagtcgcacccaaacaacttcattcattgtcctcagctgatgaattgagggaacagccttgtaaaatcaggaaagccgtccaaaagagcacttctgaaaatcagactgaatggaatgcacgtgacgatgaaggtgttccaaatagtgacagtagcactgactctgaggaacagcttgatgttaccataaaaccatcgactgaggatagagagaggggcatcagcagcagagaggatagcccacaagtctgtgatgataaggggccttttaaggacaccaggacccaagaagataaaaggagagatgttgatctggatttgtctgataaagattacagtagcgatgagtctatcatggaaagcataaaacataaagtgtctgagccctcgagatcctcatccctaagtctgagtaaaatggactttgatgatgaaagaacttggactgaccttgaagagaatttgtgtaaccatgatgttgttcttgggaatgaatccacttatgggacgccgcagacatgctaccctaataatgaaataggtatcctggacaaaacaataaaaaggaagattgcaccagtcaagaggggagaagacttgagcaagtccaggaggagcagaagtcctcctacatcggagctgatgatgaaattctttccttctttgaaaccaaaaccaaagtcagattcacacttgggaaatgaactcaagttaaacataagtcaagaccaaccacctggtgacaatgctcgatcccaggttttgagagagaaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacagactttaaaacagcaaatagcagatttacgggaagatttgaaaagaaaggaaaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcgaacacatctgttcgatttcaaaacagtcagatttcttcaggaacccaggtagaaaaatacaagaaaaattatcttccaatgcaaggcacagcacagccgcctcacacgcccagcagcttgttggctgaccacctgcctccgctctcctccttcaggccattctcccgtaacatccagctctgttacactttttaacatggaggtcagattctggcacttgctcgagacccttccaaggcaatccacctcgaagatccaagtctgcacctcctcgtgatttaggcaatttggataagggacaagctgcctctcccagggagccacttgaaccactgaacttcccagatcctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtgatctactactatgcagctgcccagaccactcacacgacatacccggagggactggaagtcttacatttctcaagtggacaaatagaaaaacattacccagatggaagaaaagaaatcacgtttcctgaccagactgttaaaaacttatttcctgatggacaagaagaaagcattttcccagatggtacaattgtcagagtacaacgtgatggcaacaaactcatagagtttaataatggccaaagagaactacatactgcccagttcaagagacgggaatacccagatggcactgttaaaaccgtatatgcaaacggtcatcaagaaacgaagtacagatccggtcggataagagttaaggacaaggagggtaatgtgctaatggacacggagctgtgacgatcctcatgtga

SEQ ID NO: 5382 - DNA, 4211 bp, Homo sapiens
tggcggcccatttgtaaatgctgcggagattgaggtgtcggttcgtgctgctgagctgcccaggcttcacggagcggtgttggaaatcaatagctcttctagcctttgcattgtttaaatataatagtgtcattggactaagatgttcctgatgccaacctcttcagagttaaacagtgggcagaacttcctaacccagtggatgaccaatccttctcgggctggggtcatattaaatcgtggatttcctattttggaagcagacaaagagaagcgagcagctgtggacatttctaccagctttcctattaaaggcacacatttttctgatagcttcagctttataaatgaagaagattcacttcttgaagaacagaagttggagtcaaacaacccttacaaaccacagtcagataaatctgaaacccatacagcctttccttgcattaaaaagggaccacaggtagcggcatgtcacagtgctcctggacaccaggaagaaaacaaaaatgacttcatcccagatcttgcgagtgaattcaaagaaggggcttataaagacccactttttaaaaaacttgaacagctgaaagaagtacaacagaagaagcaggaacaattgaagaggcaacagttggagcaactacagagactcatggaagaacaagagaagctgctcaccatggtgtctgggcagtgcacacttccaggtttgagtttactgcctgatgatcagagccagaagcacaggtctccaggaaataccaccactggagagagagccacatgctgcttcccatcatatgtctacccggacccaacccaggaagaaacatacccgtccaacattttatcccatgagcaaagcaacttctgtagaactgctcatggagattttgtcttaacttcaaaacgtgcgtctcctaatttattttctgaggcacagtatcaagaagcacctgtggaaaaaaataatttaaaagaagaaaaccgtaaccatcctacaggagaaagtatcttatgttgggagaaagtgacagaacagattcaggaagcaaatgataagaacttacaaaaacatgatgattcctcagaagtggctaatattgaagaaaggcccattaaagctgctattggagaaaggaaacagacctttgaagattacttagaagaacaaattcagttggaagagcaagaactgaagcaaaaacagctgaaggaagcagaaggaccattgccaatcaaagcaaaaccaaaacaaccatttttaaaacgaggagaaggtttagctagatttactaatgccaaatctaagtttcaaaaaggcaaagaaagtaaactagtgactaaccagagcacttccgaggaccagccgctgtttaaaatggatagacagcaactccagcggaaaaccgctcttaaaaataaagagctgtgtgcagacaaccctatccttaaaaaggacagtaaagctagaaccaagagtggttctgtcaccctcagtcagaagccgaaaatgctgaagtgtagtaacaggaaaagtctttctccgtcaggattgaaaatacagacggggaagaaatgtgatgggcagtttagagaccagatcaaatttgaaaacaaagtcacatctaataataaagaaaatgtaactgagtgtccaaaaccttgcgatactggctgcacagggtggaataagacacaaggtaaagacagacttcctctttcaacagggccggccagccggctggctgctaagagccccataagggagaccatgaaagagtctgaatcttctcttgacgtttctcttcagaaaaagttagagacttgggaacgagaaaaggaaaaggaaaatttggaattagatgaatttttgtttttagaacaagctgctgatgaaatatcattttctagtaattcctcatttgtactgaaaatcttagaaagggatcaacagatctgcaaaggtcaccggatgtcttccacccctgtcaaagctgtgccacagaagacaaatccggcagatcccattagtcattgtaaccgcagtgaggatttggaccacactgcacgtgagaaggagagtgagtgtgaagtcgcacccaaacaacttcattcattgtcctcagctgatgaattgagggaacagccttgtaaaatcaggaaagccgtccaaaagagcacttctgaaaatcagactgaatggaatgcacgtgacgatgaaggtgttccaaatagtgacagtagcactgactctgaggaacagcttgatgttaccataaaaccatcgactgaggatagagagaggggcatcagcagcagagaggatagcccacaagtctgtgatgataaggggccttttaaggacaccaggacccaagaagataaaaggagagatgttgatctggatttgtctgataaagattacagtagcgatgagtctatcatggaaagcataaaacataaagtgtctgagccctcgagatcctcatccctaagtctgagtaaaatggactttgatgatgaaagaacttggactgaccttgaagagaatttgtgtaaccatgatgttgttcttgggaatgaatccacttatgggacgccgcagacatgctaccctaataatgaaataggtatcctggacaaaacaataaaaaggaagattgcaccagtcaagaggggagaagacttgagcaagtccaggaggagcagaagtcctcctacatcggagctgatgatgaaattctttccttctttgaaaccaaaaccaaagtcagattcacacttgggaaatgaactcaagttaaacataagtcaagaccaaccacctggtgacaatgctcgatcccaggttttgagagagaaaattattgaattggaaacagaaatagaaaagtttaaagctgagaacgcatctttagctaaacttcgcattgaacgagaaagtgccttggaaaaactcaggaaagaaattgcagacttcgaacaacagaaagcaaaagaattagctcgaatagaagagtttaaaaaggaggagatgaggaagctacaaaaggaacgtaaagtttttgaaaagtatactacagctgcaagaacttttccagataaaaaggaacgtgaagaaatacagactttaaaacagcaaatagcagatttacgggaagatttgaaaagaaaggaaaccaaatggtcaagtacacacagccgtctcagaagccagatacaaatgttagtcagagagaacacagacctccgggaagaaataaaagtgatggaaagattccgactggatgcctggaagagagcagaagccatagagagcagcctcgaggtggagaagaaggacaagcttgcggcaatccacctcgaagatccaagtctgcacctcctcgtgatttaggcaatttggataagggacaagctgcctctcccagggagccacttgaaccactgaacttcccagatcctgaatataaagaggaggaggaagaccaagacatacagggagaaatcagtcatcctgatggaaaggtggaaaaggtttataagaatgggtgccgtgttatactgtttcccaatggaactcgaaaggaagtgagtgcagatgggaagaccatcactgtcactttctttaatggtgacgtgaagcaggtcatgccagaccaaagagtgatctactactatgcagctgcccagaccactcacacgacatacccggagggactggaagtcttacatttctcaagtggacaaatagaaaaacattacccagatggaagaaaagaaatcacgtttcctgaccagactgttaaaaacttatttcctgatggacaagaagaaagcattttcccagatggtacaattgtcagagtacaacgtgatggcaacaaactcatagagtttaataatggccaaagagaactacatactgcccagttcaagagacgggaatacccagatggcactgttaaaaccgtatatgcaaacggtcatcaagaaacgaagtacagatccggtcggataagagttaaggacaaggagggtaatgtgctaatggacacggagctgtgacgatcctcatgtgatcatgaagtaacagtaactgactttttatgttaaaaaatgtacatttactgtggattctgtttaatttattgtgtatgtgtggggaaaagattagattctaaaataaaagtttaccctgtggc

SEQ ID NO: 5383 - DNA, 1847 bp, Homo sapiens
tttgtgtctcttgtgaacccacttgtggagcgagagggaatttgggagggccaggggttagtctggcctctgtcttagctgtcattttggcggttttttttttttttcttcaggggatttcagtctccacatagttttggagccggacttttgaagaatgattcgtgaatccggaatgggtgacagcgtcatcacggcattttattgacagaccatggattcttacagtgcaccagagtcaactcctagtgcatcctcaagacctgaagattactttataggtgccactcctctgcagaaacgattagaatcggtcaggaagcagagttcatttatcctgactccacctcgaaggaaaattccccagtgttcgcagttgcaggaagatgttgaccctcaaaaggttgcattccttctgcataaacagtggactttatatagtttaactcccttatataaattctcctatagtaatctcaaagagtattctagacttctcaatgcttttattgttgctgaaaagcaaaaaggacttgctgtggaagtgggagaagacttcaacatcaaagtgattttttctactctcctaggaatgaaaggaacacaaagggacccggaagcatttcttgtccagattgtgtcaaaatctcaattgccatctgagaatagagaaggtaaagtgctgtggactggctggttctgctgtgtatttggagacagtcttctggagactgtttcagaagatttcacctgtctgcccttattccttgcaaatggagcagagtctaacacagcaataattggaacttggtttcagaaaacctttgactgttatttcagtcctttagcaatcaatgcatttaatctttcctggatggctgccatgtggactgcatgcaaaatggaccattatgtggctactactgaatttctttggtctgtaccctgtagccctcaaagtctggacatttctttcgcaatacatccagaggatgcaaaagctctatgggacagtgtccacaaaacacctggggaggttacccaggaagaagttgacctattcatggattgcctttattcacatttccatagacatttcaaaattcatttatcagccacaagattagttcgtgtttcaacatctgtagcttcagcacatactgatggaaaaataaagattctgtgtcataaataccttattggagtgttagcatatttgacagaactggcaatttttcaaattgagtgaagccttatgtggactataagttatagattatatactcttattgataacttgcctaattgctatgctgaaagagactgcaggagaaataggcatctatctctgcatctgttttccccaccatgcctttggagttgccaagatggaagccaagaaggatctagaagaacaaagaatatggtagtagatgagccacagccaggtgcccatgtactaatcatgataacctgacatgccattctcaaaatgctgagttgttaatttcttgtcatctttaaatatatatatataggctgggcttggtggctcacacctgtaattccagcactttgggaggctgaggtgggtggatcatttgaggccaggaattcaagaccagcctggccaacatggtgaaaccccttctctactgaaaatacaataattagctgggcgtggtggcacatgcctatgatcccagctactggggaggctgaggcaggagaatcgttttaacccagaagacaggctgcagtgagccaagactgcaccactgcactccagcctgggcaacaaagtgagactctgcctcaaaaaataaaaaagaaataaaataaataaa

SEQ ID NO: 5384 - DNA, 2357 bp, Homo sapiens
ggtctctgacaggctcagctggagagggacgggttgggacgcactgtccttttgcccttccccctccgcgagcagaagctgactccgcaggagcgagggtcgcagagctgggtgagcggaaatgtccctcccagagtgaagtcgcagggcccgccccgcgtctgagggagcggaggtcttcctgggggatttcagtctccacatagttttggagccggacttttgaagaatgattcgtgaatccggaatgggtgacagcgtcatcacggcattttattgacagaccatggattcttacagtgcaccagagtcaactcctagtgcatcctcaagacctgaagattactttataggtgccactcctctgcagaaacgattagaatcggtcaggaagcagagttcatttatcctgactccacctcgaaggaaaattccccagtgttcgcagttgcaggaagatgttgaccctcaaaaggttgcattccttctgcataaacagtggactttatatagtttaactcccttatataaattctcctatagtaatctcaaagagtattctagacttctcaatgcttttattgttgctgaaaagcaaaaaggacttgctgtggaagtgggagaagacttcaacatcaaagtgattttttctactctcctaggaatgaaaggaacacaaagggacccggaagcatttcttgtccagggtctcattttgtcacccaggctggagtacagtggcacgatcttggttgactgcaacctctgtctcctgggctcaagtgatccttccaccttagccttccaagtagctgggactgcaggtgcatgccaccacactcggattgtgtcaaaatctcaattgccatctgagaatagagaaggtaaagtgctgtggactggctggttctgctgtgtatttggagacagtcttctggagactgtttcagaagatttcacctgtctgcccttattccttgcaaatggagcagagtctaacacagcaataattggaacttggtttcagaaaacctttgactgttatttcagtcctttagcaatcaatgcatttaatctttcctggatggctgccatgtggactgcatgcaaaatggaccattatgtggctactactgaatttctttggtctgtaccctgtagccctcaaagtctggacatttctttcgcaatacatccagaggatgcaaaagctctatgggacagtgtccacaaaacacctggggaggttacccaggaagaagttgacctattcatggattgcctttattcacatttccatagacatttcaaaattcatttatcagccacaagattagttcgtgtttcaacatctgtagcttcagcacatactgatggaaaaataaagattctgtgtcataaataccttattggagtgttagcatatttgacagaactggcaatttttcaaattgagtgaagccttatgtggactataagttatagattatatactcttattgataacttgcctaattgctatgctgaaagagactgcaggagaaataggcatctatctctgcatctgttttccccaccatgcctttggagttgccaagatggaagccaagaaggatctagaagaacaaagaatatggtagtagatgagccacagccaggtgcccatgtactaatcatgataacctgacatgccattctcaaaatgctgagttgttaatttcttgtcatctttaaatatatatatataggctgggcttggtggctcacacctgtaattccagcactttgggaggctgaggtgggtggatcatttgaggccaggaattcaagaccagcctggccaacatggtgaaaccccttctctactgaaaatacaataattagctgggcgtggtggcacatgcctatgatcccagctactggggaggctgaggcaggagaatcgttttaacccagaagacaggctgcagtgagccaagactgcaccactgcactccagcctgggcaacaaagtgagactctgcctcaaaaaataaaaaagaaataaaataaataaatacagcgtttattatgtttaaactcttaggattcaaatgagatgtatctaatggatatttctgatttgggtctttaaaacctttaatctcttttaagcattttagacttgcattcagaaagaattctgtcttctaaagacattttcctagcatttcactgcggagaactggcaatcaaaatcccctcaaaagggaactaaagattaatatacacatttttttagtcattaatatgcttctgttttaaatacagttcaactcctgttgcaatgttgaattaaatgtttattttaaaatgaa

SEQ ID NO: 5385 - DNA, 1771 bp, Homo sapiens
gcccgccccgcgtctgagggagcggaggtcttcctgggggatttcagtctccacatagttttggagccggacttttgaagaatgattcgtgaatccggaatgggtgacagcgtcatcacggcattttattgacagaccatggattcttacagtgcaccagagtcaactcctagtgcatcctcaagacctgaagattactttataggtgccactcctctgcagaaacgattagaatcggtcaggaagcagagttcatttatcctgactccacctcgaaggaaaattccccagtgttcgcagttgcaggaagatgttgaccctcaaaaggttgcattccttctgcataaacagtggactttatatagtttaactcccttatataaattctcctatagtaatctcaaagagtattctagacttctcaatgcttttattgttgctgaaaagcaaaaaggacttgctgtggaagtgggagaagacttcaacatcaaagtgattttttctactctcctaggaatgaaaggaacacaaagggacccggaagcatttcttgtccagattgtgtcaaaatctcaattgccatctgagaatagagaaggtaaagtgctgtggactggctggttctgctgtgtatttggagacagtcttctggagactgtttcagaagatttcacctgtctgcccttattccttgcaaatggagcagagtctaacacagcaataattggaacttggtttcagaaaacctttgactgttatttcagtcctttagcaatcaatgcatttaatctttcctggatggctgccatgtggactgcatgcaaaatggaccattatgtggctactactgaatttctttggtctgtaccctgtagccctcaaagtctggacatttctttcgcaatacatccagaggatgcaaaagctctatgggacagtgtccacaaaacacctggggaggttacccaggaagaagttgacctattcatggattgcctttattcacatttccatagacatttcaaaattcatttatcagccacaagattagttcgtgtttcaacatctgtagcttcagcacatactgatggaaaaataaagattctgtgtcataaataccttattggagtgttagcatatttgacagaactggcaatttttcaaattgagtgaagccttatgtggactataagttatagattatatactcttattgataacttgcctaattgctatgctgaaagagactgcaggagaaataggcatctatctctgcatctgttttccccaccatgcctttggagttgccaagatggaagccaagaaggatctagaagaacaaagaatatggtagtagatgagccacagccaggtgcccatgtactaatcatgataacctgacatgccattctcaaaatgctgagttgttaatttcttgtcatctttaaatatatatatataggctgggcttggtggctcacacctgtaattccagcactttgggaggctgaggtgggtggatcatttgaggccaggaattcaagaccagcctggccaacatggtgaaaccccttctctactgaaaatacaataattagctgggcgtggtggcacatgcctatgatcccagctactggggaggctgaggcaggagaatcgttttaacccagaagacaggctgcagtgagccaagactgcaccactgcactccagcctgggcaacaaagtgagactctgcctcaaaaaataaaaaagaaataaaataaataaa

SEQ ID NO: 5386 - DNA, 1398 bp, Homo sapiens
cacctcgctcgcagcctccccagcgcagcagcccggctgtgggcctgcggcagccgggtcttcctggtccccacctcctggggccgacgggcggcaggaaggggctcggcgggacgcgccatcagggacctgaggaggaacaacggaacgcgttcggaacggcctggactcccgagactcacccgactcgtggccacaccgggagaactgaagcggcagtagccggcggagacgcccgacccgaaggccggctgctagggagcagacagctgaaccgcttgccagacgccgaaacccagtgacgccctccaccgctccaccgtgctcccggctcctcgcccccgccgcccgcgggccccaaggcgcatgcgccgcctgtcctggaggggcccatttccgtccgtcgtggggggaggcacagtgagtccactggggcacggcagcgtctaagccacaagccgagcacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggagcttggaggcggcgggaactgcaattggtggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggaagtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggagttagaagctactgggaaaatctacctccgacaagaggagatcattttagatattaccgaaatgaagaaagcttgcaattagtgaacatgaaaggaaaataaaaattcctcacagtcatctttttataa

SEQ ID NO: 5387 - DNA, 2481 bp, Homo sapiens
gagcgacgcccacggcctgtctcggccaccagcgtgttccagcgagcgcccagccacctcgctcgcagcctccccagcgcagcagcccggctgtgggcctgcggcagccgggtcttcctggtccccacctcctggggccgacgggcggcaggaaggggctcggcgggacgcgccatcagggacctgaggaggaacaacggaacgcgttcggaacggcctggactcccgagactcacccgactcgtggccacaccgggagaactgaagcggcagtagccggcggagacgcccgacccgaaggccggctgctagggagcagacagctgaaccgcttgccagacgccgaaacccagtgacgccctccaccgctccaccgtgctcccggctcctcgcccccgccgcccgcgggccccaaggcgcatgcgccgcctgtcctggaggggcccatttccgtccgtcgtggggggaggcacagtgagtccactggggcacggcagcgtctaagccacaagccgagcacataagccaggtcctaacggagcctatgtgtaagtccactactggtgcaaggttgcacacttctaagaagagcggcgtggggggctcggcgaccttcgcttcagtcgctcccccgtgcagtcccctgtgcccaagacacagcctgatgcttgtgctccggtgggcggagcttggaggcggcgggaactgcaattggtggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggaagtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggcgctgacaattgctagcaaacaccatcagattgtgaaaatggacctgagaagtcggtatctggactctcttaaggctattgtttttaaacagtataatcagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagagggaagaacccctccgatgcctaataaagttctctagcccacatcttctggaagcattgaaatccttagcaccagcgggtattgcagatgctccactttctccactgctcacttgcatacccaacaagagaatgaattattttaaaattagagataaataagacgtgcgtggtttcttaagcacagctcctccttcttgatattgcacatgcacttcagttcatggctagctgtatagcttccgtctgtaaacttgtattttcaagaatccttggtattgaatttttagaaatgctcacataattgttgggactgattcattcctccacgatatgcctcctctctctgatatcctgctaactgtagccgttgtggcatttgagatgacaggacatatatatatatggccccacacttgaccttgagtgcctgaatgctctgaaatcaagcatatggcacagcgctcaagacttttgggtttgtgtccttttttctatggctgtctcttctcaattctggagaggtctggttccagtggctggtttccagggattgattcttaagctctggatcacagagagaagcaacaaggaactatactcaactcaaaactttttaggagaatcatgaaattggtctattcaaaggatggagttgagtccattctgttattgttgcaagaggttgcatatttggtgagtcagttatataaaatagtgttcttattgtaaatatgatacttctcataatctattttatcatgtgtataacattcaaactgacaaatatattgacttatgaataaaggtgtcaaaaaactggcacatcagtt

SEQ ID NO: 5388 - DNA, 971 bp, Homo sapiens
tcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggaagtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagagggaagaacccctccgatgcctaataaagttctctagcccacatcttctggaagcattgaaatccttagcaccagcgggtattgcagatgctccactttctccactgctcacttgcatacccaacaagagaatgaattattttaaaattagagataaataagacgtgcgt

SEQ ID NO: 5389 - DNA, 1692 bp, Homo sapiens
aattggtggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttgtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggcgctgacaattgctagcaaacaccatcagattgtgaaaatggacctgagaagtcggtatctggactctcttaaggctattgtttttaaacagtataatcagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagagggaagaacccctccgatgcctaataaagttctctagcccacatcttctggaagcattgaaatccttagcaccagcgggtattgcagatgctccactttctccactgctcacttgcatacccaacaagagaatgaattattttaaaattagagataaataagacgtgcgtggtttcttaagcacagctcctccttcttgatattgcacatgcacttcagttcatggctagctgtatagcttccgtctgtaaacttgtattttcaagaatccttggtattgaatttttagaaatgctcacataattgttgggactgattcattcctccacgatatgcctcctctctctgatatcctgctaactgtagccgttgtggcatttgagatgacaggacatatatatatatggccccacacttgaccttgagtgcctgaatgctctgaaatcaagcatatggcacagcgctcaagacttttgggtttgtgtccttttttctatggctgtctcttctcaattctggagaggtctggttccagtggctggtttccagggattgattcttaagctctggatcacagagagaagcaacaaggaactatactcaactcaaaactttttaggagaatcatgaaattggtctattcaaaggatggagttgagtccattctgttattgttgcaagaggttgcatatttggtgagtcagttatataaaatagtgttcttattgtaaatatgatacttctcataatctattttatcatgtgtataacattcaaactgacaaatatattgacttatgaataaaggtgtc

SEQ ID NO: 5390 - DNA, 1556 bp, Homo sapiens
ggctttgaaggcgcggcgagcgggaacagctcttgaggagtgagactgcaggagatgtgggccgtgccaaagagatggatgagactgttgctgagttcatcaagaggaccatcttgaaaatccccatgaatgaactgacaacaatcctgaaggcctgggattttttgtctgaaaatcaactgcagactgtaaatttccgacagagaaaggaatctgtagttcagcacttgatccatctgtgtgaggaaaagcgtgcaagtatcagtgatgctgccctgttagacatcatttatatgcaatttcatcagcaccagaaagtttgggaagtttttcagatgagtaaaggaccaggtgaagatgttgacctttttgatatgaaacaatttaaaaattcgttcaagaaaattcttcagagagcattaaaaaatgtgacagtcagcttcagagaaactgaggagaatgcagtctggattcgaattgcctggggaacacagtacacaaagccaaaccagtacaaacctacctacgtggtgtactactcccagactccgtacgccttcacgtcctcctccatgctgaggcgcaatacaccgcttctgggtcaggcgctgacaattgctagcaaacaccatcagattgtgaaaatggacctgagaagtcggtatctggactctcttaaggctattgtttttaaacagtataatcagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagagggaagaacccctccgatgcctaataaagttctctagcccacatcttctggaagcattgaaatccttagcaccagcggcacttgtttgcaggatccaaaagctgctctgctattctggaagccacagtcaagggacccaggacccgagcagctggcagaaggacttgtaccttctgtttgtcccattgtatccaagatgttaaaatcatgatgtcacaacatttagacatttaaatggttaatcaaatgtatgtctctcctgatatacagctaactgctatagactaatgcaggcctccttgttaaaatggaccctttgttactcaaatttgaccaatcttggaagcttggatgtgcactgacttgacaaccactttttgtgggacataacactctagacacaggtgcttctagctctaaggggaacagataactaatctgtggccaaccaaccaatgattaatcagctatgctgcctcggatcttgatcaaaaaaggaaaatgtgaaaagtgatacacaaaatggcatcactttggttcagagctctaaaatggagttgggaagccattctaagaaggactgcctgcacaatctgcaacttgcaaaacacaaaaacaaaaaa

SEQ ID NO: 5391 - DNA, 1625 bp, Homo sapiens
gaagacgtggatggcgggaattctcgcttctggcctgggtgagctagaagggagaagcaaggacattggagtccctatcaccggttgcctagacaacttcatgggaaggcccttgggaatctgagatggagcaggcgaaccctttacgtccagatggcgagtccaaaggaggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcaatgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggatatgagtctggtctcctaatagattgttttcactgcactgggagcacatcagagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagccctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacacacaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgtt

SEQ ID NO: 5392 - DNA, 4386 bp, Homo sapiens
atgcgccccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctggcaaggacattggagtccctatcaccggttgcctagacaacttcatgggaaggcccttgggaatctgagatggagcaggcgaaccctttacgtccagatggcgagtccaaaggaggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcaatgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggatatgagtctggtctcctaatagattgttttcactgcactgggagcacatcagagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagccctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacacacaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcaggagttgtccaccacctggtggggcagtgtgacagaggggccattggggaaggtggctagcttatcccgccccttcaagaagaaggtcagcagctcccccttccccttcacaaagatggggcctcgcctcacaaagcggaagccgtactctcggaggatgacttgggtttcttctaccacctggagagggagggggagcaagaacgtggcgttacggggggagcctagactgagggcgggtgggggctttgggtggttggagccgagcactgatccatgggtcccaagcagtacgggacactccccaaacctcccagggccaagcccttccacccgtggcgagcagcgggtgggaaggagaaccctggagtgactggctgggggcctcctctcatccagagacttctctcctaggatggccatggtcacctgggtggcagcactgttacctggaaactgccactgcctgctcttctgtccctttgcccctttcgtggagcttttctgccagacgccactgagacagatcacaaggtattagaaggttcatacccaaaggtaggccatatgcatctagaacttcagcccagattttgtggatgggtggaagtgtttcttcctgtgctgaggctagctattgcagagattcttttccacttgccccacgtctctgcctctggacttactgttcagggccagggtgggaggcaggggcacgtgggaaagcactgttccggttttgttctcatgccgagtctgagcacgtgccagctgtgccactggacatacctgaatgttgcccatgacccccgtggactccatcctgctggctacattgactgtattgccccagatgtcgtagtgtggtttccgggctccgatgaccccagccagaaccccgcctttgttcatgcctagggtagaggcataaagttcagcacagccacaggccacaccttgttatgggcctcagaagccatctcctctccagacctgtaccacaaagctcctaatgtaacacatcattgtcctcattcaacttggctgtatgctattggagggtggaaatcacatctcctgtttatccgtgtgcttgttaggtgtcagccgccaccccccccccatatgcagatttactcggcatggtagtggccagcttctaacacagctggtatttcaagtctcctgggacctcactcaggaatgataccccctcagtagaagcagcaggtgatcttaactcctttcaaagagcaggcctgtctgggaagccatgtcctcagcaggcacagcaacccctctggaaatggatcacaaactcacttctcagccaggcaggccaagcttctattgtaacagtaggcacagtatagtcggatcatcacatcagctgggtttttggtttagtcatctagagtcgtctggactaaaggtctttcaggtctccttgccctgtgagtgcgtgaacctccccacccgaattgcctcagttgtcctgagcctcatgtctctcctggtggtgggccaggcccctgcatgggaagggagcctgctgcggggcaggccagctgggggtgctcacctatgcgcagcatgaagttattgaaggactggttgttgatgttggtgagcgtatccttcatggccagcgcgaagtcggccaggtcagccaggtgctgccagcgctctctctcggacttgtcttcctgtgccaggggaccgtggagaaagtgtcaggggccgctcactgcagcagcctgctctgctgccttccctggcagtgttctgggggtggattccctacacctagatgttcaaggccttacttttcctcccacaaaggagtcgcagccacgctagctctgacttgccactgtgacaaagttcacgtagcaggtctaggcaaagactgggcaattgagcagaggagacggacctgtgagtctgaccacgaggcggaccccttcaccttggctgggcctggtcctggtccttaggttttgtcaggttgtccttgtttggatccctcaactaggtgataagcactggagggggatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagttctgaaggccatgctttcagtttcccttgttgacaattgctctccagttcctatgaaagcacagagccttagggggcctggccacagaacacaaccatcttaggcctgagctgtgaacagcagggggttgtgtgtctgttctgtttctctgcttgccgaactttctcaataaaccctatttcttatttata

SEQ ID NO: 5393 - DNA, 4272 bp, Homo sapiens
atgcgccccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctgggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcaatgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggatatgagtctggtctcctaatagattgttttcactgcactgggagcacatcagagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagccctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacacacaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcaggagttgtccaccacctggtggggcagtgtgacagaggggccattggggaaggtggctagcttatcccgccccttcaagaagaaggtcagcagctcccccttccccttcacaaagatggggcctcgcctcacaaagcggaagccgtactctcggaggatgacttgggtttcttctaccacctggagagggagggggagcaagaacgtggcgttacggggggagcctagactgagggcgggtgggggctttgggtggttggagccgagcactgatccatgggtcccaagcagtacgggacactccccaaacctcccagggccaagcccttccacccgtggcgagcagcgggtgggaaggagaaccctggagtgactggctgggggcctcctctcatccagagacttctctcctaggatggccatggtcacctgggtggcagcactgttacctggaaactgccactgcctgctcttctgtccctttgcccctttcgtggagcttttctgccagacgccactgagacagatcacaaggtattagaaggttcatacccaaaggtaggccatatgcatctagaacttcagcccagattttgtggatgggtggaagtgtttcttcctgtgctgaggctagctattgcagagattcttttccacttgccccacgtctctgcctctggacttactgttcagggccagggtgggaggcaggggcacgtgggaaagcactgttccggttttgttctcatgccgagtctgagcacgtgccagctgtgccactggacatacctgaatgttgcccatgacccccgtggactccatcctgctggctacattgactgtattgccccagatgtcgtagtgtggtttccgggctccgatgaccccagccagaaccccgcctttgttcatgcctagggtagaggcataaagttcagcacagccacaggccacaccttgttatgggcctcagaagccatctcctctccagacctgtaccacaaagctcctaatgtaacacatcattgtcctcattcaacttggctgtatgctattggagggtggaaatcacatctcctgtttatccgtgtgcttgttaggtgtcagccgccaccccccccccatatgcagatttactcggcatggtagtggccagcttctaacacagctggtatttcaagtctcctgggacctcactcaggaatgataccccctcagtagaagcagcaggtgatcttaactcctttcaaagagcaggcctgtctgggaagccatgtcctcagcaggcacagcaacccctctggaaatggatcacaaactcacttctcagccaggcaggccaagcttctattgtaacagtaggcacagtatagtcggatcatcacatcagctgggtttttggtttagtcatctagagtcgtctggactaaaggtctttcaggtctccttgccctgtgagtgcgtgaacctccccacccgaattgcctcagttgtcctgagcctcatgtctctcctggtggtgggccaggcccctgcatgggaagggagcctgctgcggggcaggccagctgggggtgctcacctatgcgcagcatgaagttattgaaggactggttgttgatgttggtgagcgtatccttcatggccagcgcgaagtcggccaggtcagccaggtgctgccagcgctctctctcggacttgtcttcctgtgccaggggaccgtggagaaagtgtcaggggccgctcactgcagcagcctgctctgctgccttccctggcagtgttctgggggtggattccctacacctagatgttcaaggccttacttttcctcccacaaaggagtcgcagccacgctagctctgacttgccactgtgacaaagttcacgtagcaggtctaggcaaagactgggcaattgagcagaggagacggacctgtgagtctgaccacgaggcggaccccttcaccttggctgggcctggtcctggtccttaggttttgtcaggttgtccttgtttggatccctcaactaggtgataagcactggagggggatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagttctgaaggccatgctttcagtttcccttgttgacaattgctctccagttcctatgaaagcacagagccttagggggcctggccacagaacacaaccatcttaggcctgagctgtgaacagcagggggttgtgtgtctgttctgtttctctgcttgccgaactttctcaataaaccctatttcttatttata

SEQ ID NO: 5394 - DNA, 3088 bp, Homo sapiens
gaattttcatagcgcatgggggaaaccagactctcccagaaccgcaagcctagaaatctgtgagattccacttgatttccctgcttttgggaggaggcttttgaccataaaatgccgtctcatcatgaagctgactttcaccaaggtaggccctttcccttactgcagtgggagccgcaccaccactgggcacagtgaggataccagggtgggctcctgcccatgcccaggacggtgtgtgggctggacaccactggggtgagtcctgaggacggacaggcgaggggcgtccaggctcggccacagccctcacggagcctcagctcaaagggcttttcaggtcagatgctaaaaccgtgagaaaacagctgctttccagcaaagagcctgacgcatccgcttggggaatcctctgaccagtcctctccagaccgtctgggttgtgacagacaagggcagaccaaggagccatcccagatggaaagggtgtggggaaacctgtgaaatgagaatacagctgtagggaggttatgtacaatgttcatgatggggaagcagcagtcatgggagcctggaggctgtggagagacctacagtggggcggacgtgtgtgacagcaagggcaagaggggcggttggcacccatggatgctgcgcaaacactcggaccctgattttcgccagacacctggaacggtgccccgtgcccctcccatggcccctttctccccaccagtggatctgtctacccgtttcttctccccatgcaggaaaagtacccagatgccgtgtacctctcggaggggccctcctcctgctccatggggatccgcagcgccagccggccagggtttgaattagtcattgtttggaggatacaaatagatgaagatgggaaggtttttccaaagctggatcttctcaccaaagtcccacagcgagccctggagctggacaagaacagagccatagaaactgctcctctcagcttccgaaccctggtaggactgcttggaatcgaagctgctctggaaagcctgataaaatcgctttgtgcagaggagaacaactagttccaaaacagtgaacgtggaggatgaagatgctgcgtggaggaacatgcaattttattcaatataaacatttgctattttctgcttagaaaccacaccctgaagacgtgctgtctatgcagttatggcacattatatggaaactctcatgacatgaaaaataaatacaactagttaagtataaaatgccaaataaaagtgacacgtacaatgtggtttataaaaataagcttaacatctgagaaaatgtaccaagtggttgtgtgtcctcagatgtgtggggaggatccatcccccacccactgcagcctcacaccgagtccaccttggacatggtggccacattactcagctgggagaagccacccttatcctggttcctgcctcctgggggctctggagacggatgcctatggcgcctcatctttaaactgtccttagtagcccaggggagccacaccctcactccctgcctccccccggtccgcatggtggcaccgtgaggcagtctcagcaagtcctcatgctgttcttggtcttccacaagaaagtgaagctgtcagcttaataacaagaatggcctaagacagcaaagacagcactgttcctgggctgggacgcaaggaatgaggtcctttatgaaagaaagacccccctgcatagcctaagtgctatatcgatcgtcccggatgtgccttaagaaccgtgacctcatcagtcgcccatttagcattgttaagatctgtgaacgcgtgttgtctcaaaccagtcagggccgtcatgactacgcagcagcagcagtttccaagacgggccagaaacgcatccacagcagtggcacccgcggctcaggggctcctcacagcccgggctggtgggagccaagaccagacagagtgggggtctccatctgttttctcttctccctcaaatacaggctgttttcatcgtgtctagtccagccctgtctgggccctgtgctaggcaataactcttgcagccctgaaggacctagggagcccagcccaccttcccacggactggggttccctcacatgtgcacttgaacccaggacccagcatcctccacacaccgtgacaatgggcaaaatcatcccaaaccaggctgccccagccccagcccagcaacagtgaactcccttgggtcaagacagtactcaacggccactacctccacgcttcccagagcctgcggcttgtccgtgagctccgtgcacttcaccaaagcccccatcccagcacacaggacccgtgtgtatgagacggtgtcattggaagtgagaagaaaacagtaaaagtgtccagttagataagtatctttttgcacctctgagagtagaattagaagtaaatatgacagaattgaacaataaattctagaagagttgccttgattcaaacaagtataattctcaagttatcacaaaatttcccacaaaaatttacaatcagcaaaatagtttccttatttctcatgtatcattttcatataattccatggtttcactaatattatatgttacaataagcctccattagtccctcaaaacgatgatataaataagtctgtacaacctagcatagaataaaaaactgaaaccaagattcccaacgtttttcatagcagccgggcacactttggtgaccccaacgagaaccctctcggcagcagccaggagctgttcaccttccagaagcagggcctgtggcagcctaacagggagaggccacggggcccaaaaacgcaacacgtctcaaggcaaacccgagggaggaacttggtctgggaggaagagagaactcgctcctcaaccaccccagacactggagtgtcaggaaagcactgagctgttggggcacactgcccagcccggccacagcagctcagccagtcacagctccacctccaacttctacagcagcaatttttagtgggaaagaacagctcatctccccctcatgtgaaagattaaattgtaaagcaaaaaaaaaaa

SEQ ID NO: 5395 - DNA, 2570 bp, Homo sapiens
tttgctgtctcctgccctggctctcttcctgtccatacaggcccattattcatgcttgcatttgctgtttgtttattaaaattccccagctcttcgttttaaaaatgccattgggatatatttccagtagagtgggtctctttcaactctgggtttccctggttcttcccaagtctgtacaaacaagaaaagttgggtcaagggaggatggaggctcccagctggtctgttctgcaaaggtctggagatgaggaaaagtacccagatgccgtgtacctctcggaggggccctcctcctgctccatggggatccgcagcgccagccggccagggtttgaattagtcattgtttggaggatacaaatagatgaagatgggaaggtttttccaaagctggatcttctcaccaaagtcccacagcgagccctggagctggacaagaacagagccatagaaactgctcctctcagcttccgaaccctggtaggactgcttggaatcgaagctgctctggaaagcctgataaaatcgctttgtgcagaggagaacaactagttccaaaacagtgaacgtggaggatgaagatgctgcgtggaggaacatgcaattttattcaatataaacatttgctattttctgcttagaaaccacaccctgaagacgtgctgtctatgcagttatggcacattatatggaaactctcatgacatgaaaaataaatacaactagttaagtataaaatgccaaataaaagtgacacgtacaatgtggtttataaaaataagcttaacatctgagaaaatgtaccaagtggttgtgtgtcctcagatgtgtggggaggatccatcccccacccactgcagcctcacaccgagtccaccttggacatggtggccacattactcagctgggagaagccacccttatcctggttcctgcctcctgggggctctggagacggatgcctatggcgcctcatctttaaactgtccttagtagcccaggggagccacaccctcactccctgcctccccccggtccgcatggtggcaccgtgaggcagtctcagcaagtcctcatgctgttcttggtcttccacaagaaagtgaagctgtcagcttaataacaagaatggcctaagacagcaaagacagcactgttcctgggctgggacgcaaggaatgaggtcctttatgaaagaaagacccccctgcatagcctaagtgctatatcgatcgtcccggatgtgccttaagaaccgtgacctcatcagtcgcccatttagcattgttaagatctgtgaacgcgtgttgtctcaaaccagtcagggccgtcatgactacgcagcagcagcagtttccaagacgggccagaaacgcatccacagcagtggcacccgcggctcaggggctcctcacagcccgggctggtgggagccaagaccagacagagtgggggtctccatctgttttctcttctccctcaaatacaggctgttttcatcgtgtctagtccagccctgtctgggccctgtgctaggcaataactcttgcagccctgaaggacctagggagcccagcccaccttcccacggactggggttccctcacatgtgcacttgaacccaggacccagcatcctccacacaccgtgacaatgggcaaaatcatcccaaaccaggctgccccagccccagcccagcaacagtgaactcccttgggtcaagacagtactcaacggccactacctccacgcttcccagagcctgcggcttgtccgtgagctccgtgcacttcaccaaagcccccatcccagcacacaggacccgtgtgtatgagacggtgtcattggaagtgagaagaaaacagtaaaagtgtccagttagataagtatctttttgcacctctgagagtagaattagaagtaaatatgacagaattgaacaataaattctagaagagttgccttgattcaaacaagtataattctcaagttatcacaaaatttcccacaaaaatttacaatcagcaaaatagtttccttatttctcatgtatcattttcatataattccatggtttcactaatattatatgttacaataagcctccattagtccctcaaaacgatgatataaataagtctgtacaacctagcatagaataaaaaactgaaaccaagattcccaacgtttttcatagcagccgggcacactttggtgaccccaacgagaaccctctcggcagcagccaggagctgttcaccttccagaagcagggcctgtggcagcctaacagggagaggccacggggcccaaaaacgcaacacgtctcaaggcaaacccgagggaggaacttggtctgggaggaagagagaactcgctcctcaaccaccccagacactggagtgtcaggaaagcactgagctgttggggcacactgcccagcccggccacagcagctcagccagtcacagctccacctccaacttctacagcagcaatttttagtgggaaagaacagctcatctccccctcatgtgaaagattaaattgtaaagcaaaaaaaaaaa

SEQ ID NO: 5396 - DNA, 8766 bp, Homo sapiens
gcctccgtcacctccccctcaacgactgcaaaagagcctaaaccaaaatcccctagtttctattgaacactatcgctgtgtgtaccaattcctggactaggtcggcgtaagagaggaagtaggtgaaaaaaataaagaggcgctcccctccacgtgatcccagccctgcctctttagtgaggcacgcggccgggcggctccaaggctgccggctagggtgagcagcggagcgcttgggcttggagtagcaaagaacgcgctctccagagaaagtatagccactgcttagacagccagggaaacgtgtgcggggaagtggaggactcaggctctcgtgcgagagcggagttggacgtgcagggccgctggggtcacgcggagctctcccgcctcccctccgcgtgagctctgggatggtccgcgccgggagcgcgcgcgaggcttgaagcgcgggtgaagcgcgcaggtcggagtgacagctgcgctgccggcccggctgcggtcagcaacgcgccatggacgcagagctggcagaggtgcgcgccttgcaagctgagatcgcggccctgcggcgagcgtgtgaggacccaccggcgccctgggaagagaagtcccgagtccaaaaatcttttcaagccatacaccaattcaatttggaaggatggaagtcttcaaaagatctgaaaaatcagcttggacatttagaatcagaactttcatttctaagtacgcttactggcatcaatataagaaatcactccaagcagacagaagacctaacaagcactgagatgacagaaaagagtattagaaaagttctacagagacacagattatcaggaaattgccacatggttacatttcaacttgaatttcagattctggaaattcagaataaggagagattatcttctgctgttactgacctcaacataataatggagcccacagaatgctcagaattaagtgaatttgtgtctagagcagaagagagaaaagatctgttcatgtttttccgaagcctgcatttttttgtggagtggtttgaatatcgtaagcgcacgtttaaacatctcaaggaaaagtacccagatgccgtgtacctctcggaggggccctcctcctgctccatggggatccgcagcgccagccggccagggtttgaattagtcattgtttggaggatacaaatagatgaagatgggaaggtttttccaaagctggatcttctcaccaaagtcccacagcgagccctggagctggacaagaacagagccatagaaactgctcctctcagcttccgaaccctggtaggactgcttggaatcgaagctgctctggaaagcctgataaaatcgctttgtgcagaggagaacaactagttccaaaacagtgaacgtggaggatgaagatgctgcgtggaggaacatgcaattttattcaatataaacatttgctattttctgcttagaaaccacaccctgaagacgtgctgtctatgcagttatggcacattatatggaaactctcatgacatgaaaaataaatacaactagttaagtataaaatgccaaataaaagtgacacgtacaatgtggtttataaaaataagcttaacatctgagaaaatgtaccaagtggttgtgtgtcctcagatgtgtggggaggatccatcccccacccactgcagcctcacaccgagtccaccttggacatggtggccacattactcagctgggagaagccacccttatcctggttcctgcctcctgggggctctggagacggatgcctatggcgcctcatctttaaactgtccttagtagcccaggggagccacaccctcactccctgcctccccccggtccgcatggtggcaccgtgaggcagtctcagcaagtcctcatgctgttcttggtcttccacaagaaagtgaagctgtcagcttaataacaagaatggcctaagacagcaaagacagcactgttcctgggctgggacgcaaggaatgaggtcctttatgaaagaaagacccccctgcatagcctaagtgctatatcgatcgtcccggatgtgccttaagaaccgtgacctcatcagtcgcccatttagcattgttaagatctgtgaacgcgtgttgtctcaaaccagtcagggccgtcatgactacgcagcagcagcagtttccaagacgggccagaaacgcatccacagcagtggcacccgcggctcaggggctcctcacagcccgggctggtgggagccaagaccagacagagtgggggtctccatctgttttctcttctccctcaaatacaggctgttttcatcgtgtctagtccagccctgtctgggccctgtgctaggcaataactcttgcagccctgaaggacctagggagcccagcccaccttcccacggactggggttccctcacatgtgcacttgaacccaggacccagcatcctccacacaccgtgacaatgggcaaaatcatcccaaaccaggctgccccagccccagcccagcaacagtgaactcccttgggtcaagacagtactcaacggccactacctccacgcttcccagagcctgcggcttgtccgtgagctccgtgcacttcaccaaagcccccatcccagcacacaggacccgtgtgtatgagacggtgtcattggaagtgagaagaaaacagtaaaagtgtccagttagataagtatctttttgcacctctgagagtagaattagaagtaaatatgacagaattgaacaataaattctagaagagttgccttgattcaaacaagtataattctcaagttatcacaaaatttcccacaaaaatttacaatcagcaaaatagtttccttatttctcatgtatcattttcatataattccatggtttcactaatattatatgttacaataagcctccattagtccctcaaaacgatgatataaataagtctgtacaacctagcatagaataaaaaactgaaaccaagattcccaacgtttttcatagcagccgggcacactttggtgaccccaacgagaaccctctcggcagcagccaggagctgttcaccttccagaagcagggcctgtggcagcctaacagggagaggccacggggcccaaaaacgcaacacgtctcaaggcaaacccgagggaggaacttggtctgggaggaagagagaactcgctcctcaaccaccccagacactggagtgtcaggaaagcactgagctgttggggcacactgcccagcccggccacagcagctcagccagtcacagctccacctccaacttctacagcagcaatttttagtgggaaagaacagctcatctccccctcatgtgaaagattaaattgtaaagcaaaaaaaaaaaggtcaatgctcgcatgagtggtgtccatcctgacctgagccttgcgctccctgctgccctgtgtggaactgtgggcttcagcacctccacagggaccctgagtctacactgctcagaatcggcatctgcgcgaccacgaggtcacgctgtgcagcagggaaccacctaaaaacctgtgttgatatgtggcttgcactgaaaaagtgaccatgtaactcagctgggggaagttccagtagtatccatgttttcttaaaagtccaaactgtaaaatgtatgtgacaattcaagttttctatgttaggagtctggtggtagcagatccaaaccttgggtcttagaataaggcttttcgcattagagaatcagacatgagccctggttgggaaagaagaactatccagaacgtcttcccagggcttaacggacacttccattttaagagtgtgagcagcttcctgggacacagcactcacttcctacattccttgtccaggaagttgtttctagtgctcttcaattccatgtctccaagaggcaatcccacctcaaaaggggttaaaagcaaaaacattcacaaccaaaggtcacccaacacaacagaaaatatctctatcattcagccttcacattatgttcaagtttcaaagacactgcagggaaagagttagaccttgtggagaactaatgtgcaatcttcgctttccttgaaccgagtcgacatcacggcgttgtctttggcacgtacagtctttgaataatagttgacgatcttgccgtccagtttatactgatggggaatgctctcgtagggcttgaggtcaaggtccagcacagacacggaaaaggcaaacctggacctcgatgaagggacgacaggcctttgatcagagctgcaagtaaaaagtaccatttcaggatacacaagccccccattcatttccctccctcccgttctctctccctttcttctttcaactagtatgtttttatgttttttctttgacttctgcaaagttagataaatcaatctcttttaaaagagaagtgaatggcctcacaccccagctcacaaagagcactcgttctgtgcacctgtgatctgtgcgtgtgacagctgtctgtgccggctgtgtgcaccagcgtgcaaagcttcctcaggccagtgcaccccaccataccaggcgagagagggttaaaggactgaaagatggaaaagtaattatgtggaacatgtgagcgatgttcccccagcccagtggtataaacgaacgctgaaaaatcactttatcatgagccaagtattacaaaacccaacaaaaagtaaaaagtagatctggccattccagcgccaaatggatggaatgtcgacaagccttcttctttgcctctcctgtctgctgagaaacgcaagctcctttggttcacatttgaagagatctggtttctcattttattctcaaattttatcttcagtcctttgtattttgcttctcagggcttagttttgtggttttaacctcagaagtcgtgtgcttataacaagatgtgattaattatttgccctgaaaaacacatttaggattactccgagtcctgagctctgactgctgtgtgtcccgcttttcgtctccgggcactcagcgcacagcactcaagacactggctaaacaagtgacctaagctcagttcagtccaagagaagtatcctgggttctggtgtcccaatgtttactacgctttgagatttagaaatcaacaagccaaaccccaacttcaaaagctcctgccgaggagaggaaatactgatcagcacgtccctgctctgacgctgctcaccatggccttggcgctcactgctgccctgccccagaatcctgtttgtagaaaaaacaaatccctgactaagctgctggggtaagtaactattctcatctgaagagtaaacagcaaataactcatttacaaattaaggtcatgagtctcgctccagaagctggagtgtgcctgcagctcatcccaaggggccacattttattgggagaacctcagaagcccaaggtactgctcagttctgaggcctgagacccaagctgggtgcacctgggctggaacagtcacatccccagcccatgactagggttacgtattttaaaggacaccccaatttctcagaagcagcacctgacaagaccatgggtgtaaagacaggaaggatgttccaggcagctcccggggagggtctgactacctgggtcaaccacaagctagctccatgggaaccaatggcagtgaccagcgggcaccagctcctgacacagaaatgctcttcttccccctcagtaccccggaggccaagactgggcaagaggccccagggacacacctgtcccttgtgccacaagtgtgccctctagcagccttggagaatgaggctcaggtggccttctggctgcaggggggcagcccttgcctggaaggccgttctccaggacactgacccgctgggggttaccgggggaccagcagcctccaagggtgctggggatcggggtggagaagccaaggccgcacactgtgtttcaaatgggaggtcgagaggagcatcagggtttaggccgggaagctgtggcagctctctccacagttccaaattcccaaagggacaaagctctgcagcgacaggaaggcagatccaacttgagacattttcctttatgacagggcagaaacagtagtgcagagctggagaagcctttattttagggggtgtaagaagtttaaatgtggtcaatctatctgtgagctgcaaattagtctagggatctaaatttagtctcaggtctaccaggtatctcaagacgccaagatgactcatgataaatcccagccttagtttgtccctaggcctctagagcaccacagttactggaacttcacaggtgcggccactgcgcacaccttcctggaagcaggcccagccccacacgccatgttctcggaggagaagccttctctgagatcctctccttttgttgagaaaggcctggctagagtgctttgtgcaggatggttccagtgcctacaccctaggtctgagaagccacatggctcagtgccttcaggacatgccctcccctcccctcctagtgtcgtttctgctgagcagctggtcgtaaggacccgggccttcagctttccccgcatgctggctttccaatttgacatcactgaccaggcactaagagattcccaggtgctagacgaggtgagtaacatgtctgtccttcagcggcctttcacagcccacctaagggcaccctgcatccaagcacatttccattgcccagctgcatccttggtcggggggctgctgaacagtggtatcttcgtgggttttctctcatcgaacaccaccagcttaatccagttaaggaattcctcataacttagccctgtaggtatttccttaggggataacaggagttttcaactaaatagaacaaccttttttctacttcagttagccctataatgttcctcagtatttcatattggaaagtaaacaattctgtgcctgccagggaacaggaatcctgggaactgtttagttcaaaagcaccgggaaagtgagtggctggcagccagcaaccaaggtcatcttgacccaggaacacatgttagaagaatgtggaacattccgcaaatactgggtgcagggtttagcacccctgaagatcggtgatggagatgctgtctaacgactatgagattatcagtttcatcccgaattcccagaaacagaggggactggacaaaactagtgacattagggagaggggcggcacataggctggttattcagaagaggaagcagaatgaatgcgcgcctcacaggctttcaaatgactgtggtggtaaaaaggcaggtgcgccatgctgccactgtgggagaccgaggaacaagggccacaggtacccacacatctcaggggctggctttctttgagggaatgcaatgggcagctcactgtccacattgtttctgagctcttgggagtattttcttagaaaacagtaactttcaatgtactaacaatccttttaagttattctccataaatctgtcttttgactgaattacaagcttctagagggcgagagttagtaagccccatgatgtcacataggccaaggaagttatgtcactccgccatggagtctctaaatatggggaaaccaactatcctattaacaattcaccaactgtccataaaaccccgttagacccaggctgcatgccttgcagtgggggcctcacctggcatcctgcagacagggagacagtgcaatcatgatggagcagtccttggcagtcatggcgacgcggtactgctgcacctgcaggggcgggaaagatcagctccaggtcacacaggaagcctctgcccccccacacaaccttccttcccagtagccaagtgtgggaactgcttcctgcctcagaacctgagggtgggattaggagcgagggccacggtgagcacgggcgtcaggaggtcgccctgtgagagcacctgggccagccctcagtgccacggggctgctcagaggccagcaccgccccctgacctctcacggcaagcagtgtgggaccccgactccagaccctgagacggatgatctgtcttcagcaaggtcaccacagtcggcctttggaaggaaaagcagtaagccacctgagccccgcatgttggccacactcagagtatcaagtgagtatcactcgacacctgcaaggagagcgcagggggtgttcagcaaggcatcgcttagaacgacattccctccggaacatcatacagccaccagagacaacggcagacggccacccttctacaggctgtgcatgtgttaacttgctccaccctcacagcagcccaacagggcagcacggccggcgtcccactttacagacaagcaacagacacagacatcacttgtctgtcatgccctgcttgtcaatggcaaggcagggactcaaacccggtacgctggctctgacatttacactcttcaacacatgctccaagctatgtgggtctgtccatactgaccagggacagctcaacacacaccacactgtcagagtcgacatacgtaaagctgtacatgtgcacatgtgtgtgacgcgggcagggagaaaggtgaaggacaggcaccacaatgctcacaactgtctcctctacagagcagaatgtgaggcactctctcctcttccttctttggactttcatatatggtttgcattgttttagatggcatagctctcgctttcacaaaaataaacagttgtaaaagaaaaggaa

SEQ ID NO: 5397 - DNA, 744 bp, Homo sapiens
aagcgcgcaggtcggagtgacagctgcgctgccggcccggctgcggtcagcaacgcgccatggacgcagagctggcagaggtgcgcgccttgcaagctgagatcgcggccctgcggcgagcgtgtgaggacccaccggcgccctgggaagagaagtcccgagtccagtattagaaaagttctacagagacacagattatcaggaaattgccacatggttacatttcaacttgaatttcagattctggaaattcagaataaggagagattatcttctgctgttactgacctcaacataataatggagcccacagaatgctcagaattaagtgaatttgtgtctagagcagaagagagaaaagatctgttcatgtttttccgaagcctgcatttttttgtggagtggtttgaatatcgtaagcgcacgtttaaacatctcaaggaaaagtacccagatgccgtgtacctctcggaggggccctcctcctgctccatggggatccgcagcgccagccggccagggtttgaattagtcattgtttggaggatacaaatagatgaagatgggaaggtttttccaaagctggatcttctcaccaaagtcccacagcgagccctggagctggacaagaacagagccatagaaactgctcctctcagcttccgaaccctggtaggactgcttggaatcgaagctgctctggaaagcctgataaaatcgctttgtgcagaggagaacaactag

SEQ ID NO: 5398 - DNA, 1728 bp, Homo sapiens
ctctgtttacgaatgtttgggcgcgaattactctaagcgcggctctcagaagggtgcaagaagaatcagtgcactgtgtttagatcaagatgtctggtaaagcaaatgcttccaagaaaaacgctcaacagttaaaaagaaatccaaagagaaaaaaggataatgaggaagttgtgttgtcagagaataaggttagaaacacagtgaaaaaaaataaaaatcatctgaaagatctgtcttctgaaggacaaacaaagcacactaacctaaaacacggaaagacagcagccagcaagagaaaaacctggcaacctctgtcaaagagtaccagagaccatttgcaaactatgatggaatcagtaataatgacaattttgagtaacagtattaaagaaaaagaagaaatacaataccatctcaacttcctgaagaaaagattgctacaacagtgtgaaactctgaaagtccctcccaaaaagatggaagatttaactaatgtatcaagtctactgaatatggaaagggcacgagacaaagctaatgaagaaggtctggcattactacaggaagaaatagataaaatggtagagaccacagagttaatgactgggaatattcagagcctaaagaacaaaattcagattctggcaagtgaggtggaagaagaagaggagagagtaaaacagatgcatcaaataaatagtagtggagtactctctcttccggaactttctcagaaaactctcaaagcacccacacttcagaaagaaattttggcgctaattccaaaccagaatgctcttctaaaggacttggatattcttcataattcatcacagatgaagagcatgtcaaccttcattgaagaagcctataagaaactggatgcatcttaaagagtgttttttttttagattgttccatattaatttaatgttcgtgaatttgtaaaactgttaacctatgattatatgtacagaggctaaggcttctgcaggatttattatctcctgatatgcactttaaaattagtctttgtagttctatcattagcatctaatgtagttctgaagactgtttttagcagttgccaaatctaggaaactaacatttatattgctgtatctataagtatttgcctaaaaccataaaataggaattgccttaaggatctagtagtttataatgcctgaatggaactcatttattggttaacagctcatatcaggagctgtgataagtaagtgtttacatacactgtctagtgcataaaaaccttagtgtttgctatcattcattctgtagccaatggcttacagtttctgtctggtcatctggaacttgaaaaatcctcaaatgccttcactcttttacctaactccctagtctttttgggaagtagttaagatatgcctgctatctttaactttggaggtagtatcaaaattttacttctttggttgtttagtgaattaatgttgaatattttctactgtcatcaaaacatattcccaaaaagtattaaaaaggaaccttagcacatttattttattaaaacaagaaaacccaaaatatataaaccttttcttattatgataataagcttatatatgtgaataagttataacctagtgtataaaaaattatttctaacaaactacagtatactgtcttgggtttttttttttttttttagtctgtaaaataaaatgactgcaattacttttt

SEQ ID NO: 5399 - DNA, 1701 bp, Homo sapiens
ctcagaagggtgcaagaagaatcagtgttttttttttttcgaagcactgtgtttagatcaagatgtctggtaaagcaaatgcttccaagaaaaacgctcaacagttaaaaagaaatccaaagagaaaaaaggataatgaggaagttgtgttgtcagagaataaggttagaaacacagtgaaaaaaaataaaaatcatctgaaagatctgtcttctgaaggacaaacaaagcacactaacctaaaacacggaaagacagcagccagcaagagaaaaacctggcaacctctgtcaaagagtaccagagaccatttgcaaactatgatggaatcagtaataatgacaattttgagtaacagtattaaagaaaaagaagaaatacaataccatctcaacttcctgaagaaaagattgctacaacagtgtgaaactctgaaagtccctcccaaaaagatggaagatttaactaatgtatcaagtctactgaatatggaaagggcacgagacaaagctaatgaagaaggtctggcattactacaggaagaaatagataaaatggtagagaccacagagttaatgactgggaatattcagagcctaaagaacaaaattcagattctggcaagtgaggtggaagaagaagaggagagagtaaaacagatgcatcaaataaatagtagtggagtactctctcttccggaactttctcagaaaactctcaaagcacccacacttcagaaagaaattttggcgctaattccaaaccagaatgctcttctaaaggacttggatattcttcataattcatcacagatgaagagcatgtcaaccttcattgaagaagcctataagaaactggatgcatcttaaagagtgttttttttttagattgttccatattaatttaatgttcgtgaatttgtaaaactgttaacctatgattatatgtacagaggctaaggcttctgcaggatttattatctcctgatatgcactttaaaattagtctttgtagttctatcattagcatctaatgtagttctgaagactgtttttagcagttgccaaatctaggaaactaacatttatattgctgtatctataagtatttgcctaaaaccataaaataggaattgccttaaggatctagtagtttataatgcctgaatggaactcatttattggttaacagctcatatcaggagctgtgataagtaagtgtttacatacactgtctagtgcataaaaaccttagtgtttgctatcattcattctgtagccaatggcttacagtttctgtctggtcatctggaacttgaaaaatcctcaaatgccttcactcttttacctaactccctagtctttttgggaagtagttaagatatgcctgctatctttaactttggaggtagtatcaaaattttacttctttggttgtttagtgaattaatgttgaatattttctactgtcatcaaaacatattcccaaaaagtattaaaaaggaaccttagcacatttattttattaaaacaagaaaacccaaaatatataaaccttttcttattatgataataagcttatatatgtgaataagttataacctagtgtataaaaaattatttctaacaaactacagtatactgtcttgggtttttttttttttttttagtctgtaaaataaaatgactgcaattacttttt

SEQ ID NO: 5400 - DNA, 1829 bp, Homo sapiens
gctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagccctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaac

SEQ ID NO: 5401 - DNA, 1990 bp, Homo sapiens
agctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagtgagtgtgtggcactggtggcctggagccaaatttagcttgggtgagagttgacaatggtagttttccttcctcaagcccctctgtgcccctagagcaccctggctgtggctgcctccttcatccaagagcagagtccatgttgggccaggagacttcagatccatgtcctggtgctgcctctggctttgtctttcctcagtgggcaggactgggtctgctggtccatctttacccttctctgagctatgcagccttggcctgctgcgtctccggcctgtattctctccccttcactcaggccctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacag

SEQ ID NO: 5402 - DNA, 2202 bp, Homo sapiens
cttgtctcaggtatctgataatttacacttgatctcagtgcagattctgggaaagtgaactccacggaagactcagaaaccaagttctaattcagttgccatgaaaacttaaggtgagaggattgtcaaccagtgaaaaatacggaggaaaacactaacagaatatgatgaagaagccaagacttgggctgcttgcattacattaaccgaggtttacccgcagcgaggctgcctccaaagcatccggagtttgcaaccatcactgtccaccccgcgagctgcgatagtgcgagaactacaattcccgtggggctgtgcgggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagccctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacag

SEQ ID NO: 5403 - DNA, 952 bp, Homo sapiens
ggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaagtaaggttgggttttcccctgctggcctttggggaaagctctccccgctatgacagataggaggtgatgctgagtcagggttgcacccctctcggtggggtcaaggacagcgagcaactctggtcagtgggtctacaaggaatttctgcttgctttctacagggggcctctttccttggtccctcggtgtctcccagggccccatatccttagactatagggctggaggttgtaaaggggtgtggtgtggtggccaaaacttgttgagaggggccaggtttcaggatcagctggccaattcaaactgacct

SEQ ID NO: 5404 - DNA, 2345 bp, Homo sapiens
acccatgctgactctggagcgggccgggtggcgctgcccatccccggatccttcgtagatggagtcttgcttagtcgcccaagctggagtagtgtggctcgatctcagctctgcaacctctgcctcccagggttcaagcaattctcctgcctcagtttccagagtagctggaattatagtgcagattctgggaaagtgaactccacggaagactcagaaaccaagttctaattcagttgccatgaaaacttaaggtgagaggattgtcaaccagtgaaaaatacggaggaaaacactaacagaatatgatgaagaagccaagacttgggctgcttgcattacattaaccgaggtttacccgcagcgaggctgcctccaaagcatccggagtttgcaaccatcactgtccaccccgcgagctgcgatagtgcgagaactacaattcccgtggggctgtgcgggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagccctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 5405 - DNA, 1165 bp, Homo sapiens
ggcgcgcgcaggccggcgggggcgcgccgcgctgcgaggcctgcgcgccaggctgcgggagccatgcggcgatcgaggagctctgcggccgccaagctgcgcgggcagaagcggtccggggcctccgcggcccccgcggcctccgcggccgctgccttggcacccagcgccacccgcacacggcgctccgctagccaggccgggagcaagagccaggcggtggagaagccgccgtcggagaagccgcggctgaggcgctcgtcgccgcgggcccaggaggagggcccgggggagccgccgccgcctgagctggcgttgctcccgccaccgccgccgccgccgccgactcccgcgaccccgacgtcctcggcgtccaacctggacctgggcgagcagcgggagcgctgggagacgttccagaagcggcagaagcttacctccgagggtgccgccaagctcctgctagacacctttgaataccagggcctggtgaagcacacaggaggctgccactgtggagcagttcgttttgaagtttgggcctcagcagacttgcatatatttgactgcaattgcagcatttgcaagaagaagcagaatagacacttcattgttccagcttctcgcttcaagctcctgaagggagctgagcacataacgacttacacgttcaatactcacaaagcccagcataccttctgtaagagatgtggcgttcagagcttctatactccacgatcaaaccccggaggcttcggaattgccccccactgcctggatgagggcactgtgcggagtatggtcactgaggaattcaatggcagcgattgggagaaggccatgaaagagcacaagaccatcaagaacatgtctaaagagtgagcttctgcctctcctgccctgaaaaggaggaatgattggggccagcaactttgctctccctgccgtgcctcggtggtgctcctgaatgtggctgacctgggctgctggttccgttgactagggtcatcttgatctctgcagtttgctccagctaccagtttctttaggcagctctttgtcctccctctgcccagattttgatgtagtctaattgacatccttctcttcccaacttttgtgtgatcttttaggaaaaaaaataaatatttttaacattaaagca

SEQ ID NO: 5406 - DNA, 4900 bp, Homo sapiens
agcggctacgcaggcggcaaaaggtcctcgggtggcgggcttgtctctgcttgcagactggcagggctgcagcgtggctttttccttgagtcggggcacagttaggatctgggctggcggcccgaggcagaggagccgggcgcgctgcagcagacggcggtgggacctggctgcggagcggggtccgggcatcagggaccgggggcgggcagtgggggtcccgccgggggtcccggattacccgcgactcaactggacctcacttccccccagccgccttcgcccccggaccgctcaccgcaaccatggtctccaaatccgaccaattgctcatcgtcgtgtccatcctagaaggtcggcatttccccaaacgtccaaagcatatgcttgtagtggaagcaaagtttgatggagaacagttggctactgatcctgtggaccacactgaccagccagaatttgctactgagttagcttgggaaattgacaggaaagcgcttcatcagcacaggctacagcgtactcctatcaaactccaatgttttgccttggatcctgtaacttcagccaaggaaaccataggttacatcgttctggatttaagaaccgctcaagaaacaaagcaggcaccaaaatggtaccagttgctgagtaataaatacaccaaattcaagtctgagatacagataagtattgctttggaaaccgatacaaagccaccagtggatagctttaaagcaaagggggctccccctcgagatggaaaagtacctgccatcctggctggacttgaccccagggacattgtggctgtgctgaatgaagagggaggctaccatcagattggaccagcagaatactgtactgactcctttattatgtcagtgaccatagcatttgctacccagttggaacagttaattccatgtaccatgaaacttccagaaagacagcctgagtttttcttttactactctttactgggaaatgatgttacaaatgaacccttcaatgatttaatcaacccaaactttgagccagagagagcatcagttcgcatccgtagcagtgtagaaattcttcgtgtttacctggctcttcagtctaaactgcagattcacctctgctgtggagaccagtcacttggaagtacagaaatacctttaactggattacttaaaaagggcagtacagaaatcaaccagcacccagtcacagtcgaaggtgcttttacccttgaccctccaaacagagccaaacagaagcttgcacctattcctgtggagctagccccaactgtgggagtgtctgtggctctgcagagagaaggcatagactcccagtctttaattgaattaaagacccagaatgaacatgagccagagcattcaaagaagaaagttttaacccccataaaggagaagacacttactgggccaaaatcaccaacagtgtcccctgttccatctcacaaccagtcacctccaacaaaagatgatgcaacagaaagtgaagtggaaagtttacagtatgataaggacaccaaaccaaatccaaaagccagttcttctgtacctgcttcactggcccagctagtgactacatccaatgcttcagaagtagcttcaggacagaagattgctgtaccagcaacatcacatcatttttgcttttcaatagacttaaggagtatacatgccttggagattggttttccaatcaactgtatattaaggtactcatatccattctttggaagtgcagctcctattatgactaatcctcctgtagaagttcggaaaaacatggaagtttttcttccccagtcttactgtgcatttgattttgcaactatgcctcatcagctgcaagacaccttcttaaggattccattactggttgaactatggcacaaggataaaatgagtaaagatttacttctgggaattgcgagaatccagctttctaacatcttgtcttcagaaaaaactcgttttttaggttctaatggtgaacagtgttggcgtcaaacttacagtgaaagtgtgcctgttatagcagcacaaggatcaaataacaggatagcagatctttcttacacagtgactctagaagattatggactagtaaaaatgcgtgagatttttatctctgattcatctcagggtgtatctgccgtacagcaaaagccgtcttctcttcctccagcaccttgtccttcagagatccagacagagcctcgtgaaacgttagaatacaaagcagcacttgagctagaaatgtggaaggagatgcaagaagatatatttgaaaatcagctgaagcagaaagaactggctcatatgcaggctcttgcagaggaatggaagaaaagggaccgagaaagagaatcactagtaaagaaaaaggtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactagaaaggttaaaaatcaaacagctcgaagaggataaacaccgccttcagcaacagcttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaacagagggagcaagaaagtcaaatggctcgtcttaaaaaacagcaggaagaattggaacagatgagactacgttaccttgccgctgaggaaaaagatacagtaaaaaccgagcgacaagaattgttggatataagaaatgaattgaacaggttaaggcaacaagagcaaaaacaataccaggattccacagagattgcaagtggaaaaaaggatggcccccatggcagtgtattggaagaaggtttggatgattatttgactcgcctgatagaagaaagggatactttgatgagaacgggtgtgtataatcacgaggatcgaataataagtgaactcgaccgacagatcagagagattttggcaaaaagcaatgccagtaattaataacatttggaaaagctttatagagactctaagtctaaattttaatttctttgtaaaaacctcaaaagtgaggaaaatggatgttttaaaatggtattttcaattttttataagcaaaattttgtatgttattgtatagtatttatttgatcttatttactttatgctacctctcccacactggttttatttgtaatttgcatttatatactcattttaaatgacttttcagtgtttttcatagtttataatctgatggctaactaactttcaaaacagcttttaactaagtttgttgtaggagaaatgactgcggtaatttccagttctataatgtttcatgttgagccaaaagagtatatcttgcactttaaaaacgctgcgtcctattccatttgaatgtaaattcttaaaagttgagaccaattgtaaccagtttaactcattttagatgacctttttttcttataatatttgcaagtgacaagtttgaaaacaaagcaagatcagtgcagagaagccacatgacatgttgggtgacagattggtcatttatttaaataaagttaatacagattaaatttgtttcaagagctattgaattttcaaattttcagtgtatttataacttttaagaacatgaagtattagcttaatatagttttctctgttggtttcttcctcaagtttgcattgttttcttttgttaaaattagagatttctttttattttccagttatagtaatactagctgtcagcttaaaccctctgtaatagaacatggaaacagacacataaagacattagctgaaaaaatagagtgaaaatcaactattttttactcccgctaatttcaatcaatcgttttcaaaagcgcacgagattcactcattggatttatgcagtgccctgtctgtataaaaactcttaagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggaaggtctgcggtaaaatgctgtgactgtttactttcaattgcattgtgtgttgcctgtgactgctttcaaacgctagagggggcctctgatttaaagaaataaaaaggacttttctaaaatggatgtgtagtttattttgccttttgtaaagctcttttggctattgtaacttaacaaataaaatcataattgtgtgcatctctga

SEQ ID NO: 5407 - DNA, 4629 bp, Homo sapiens
tttacagcagtagtgcgcttgcgcagctggtcccacaccaagtcgcccgcctctcctcgtccggctagcagagggcgctgtgaggtcggcatttccccaaacgtccaaagcatatgcttgtagtggaagcaaagtttgatggagaacagttggctactgatcctgtggaccacactgaccagccagaatttgctactgagttagcttgggaaattgacaggaaagcgcttcatcagcacaggctacagcgtactcctatcaaactccaatgttttgccttggatcctgtaacttcagccaaggaaaccataggttacatcgttctggatttaagaaccgctcaagaaacaaagcaggcaccaaaatggtaccagttgctgagtaataaatacaccaaattcaagtctgagatacagataagtattgctttggaaaccgatacaaagccaccagtggatagctttaaagcaaagggggctccccctcgagatggaaaagtacctgccatcctggctggacttgaccccagggacattgtggctgtgctgaatgaagagggaggctaccatcagattggaccagcagaatactgtactgactcctttattatgtcagtgaccatagcatttgctacccagttggaacagttaattccatgtaccatgaaacttccagaaagacagcctgagtttttcttttactactctttactgggaaatgatgttacaaatgaacccttcaatgatttaatcaacccaaactttgagccagagagagcatcagttcgcatccgtagcagtgtagaaattcttcgtgtttacctggctcttcagtctaaactgcagattcacctctgctgtggagaccagtcacttggaagtacagaaatacctttaactggattacttaaaaagggcagtacagaaatcaaccagcacccagtcacagtcgaaggtgcttttacccttgaccctccaaacagagccaaacagaagcttgcacctattcctgtggagctagccccaactgtgggagtgtctgtggctctgcagagagaaggcatagactcccagtctttaattgaattaaagacccagaatgaacatgagccagagcattcaaagaagaaagttttaacccccataaaggagaagacacttactgggccaaaatcaccaacagtgtcccctgttccatctcacaaccagtcacctccaacaaaagatgatgcaacagaaagtgaagtggaaagtttacagtatgataaggacaccaaaccaaatccaaaagccagttcttctgtacctgcttcactggcccagctagtgactacatccaatgcttcagaagtagcttcaggacagaagattgctgtaccagcaacatcacatcatttttgcttttcaatagacttaaggagtatacatgccttggagattggttttccaatcaactgtatattaaggtactcatatccattctttggaagtgcagctcctattatgactaatcctcctgtagaagttcggaaaaacatggaagtttttcttccccagtcttactgtgcatttgattttgcaactatgcctcatcagctgcaagacaccttcttaaggattccattactggttgaactatggcacaaggataaaatgagtaaagatttacttctgggaattgcgagaatccagctttctaacatcttgtcttcagaaaaaactcgttttttaggttctaatggtgaacagtgttggcgtcaaacttacagtgaaagtgtgcctgttatagcagcacaaggatcaaataacaggatagcagatctttcttacacagtgactctagaagattatggactagtaaaaatgcgtgagatttttatctctgattcatctcagggtgtatctgccgtacagcaaaagccgtcttctcttcctccagcaccttgtccttcagagatccagacagagcctcgtgaaacgttagaatacaaagcagcacttgagctagaaatgtggaaggagatgcaagaagatatatttgaaaatcagctgaagcagaaagaactggctcatatgcaggctcttgcagaggaatggaagaaaagggaccgagaaagagaatcactagtaaagaaaaaggtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactagaaaggttaaaaatcaaacagctcgaagaggataaacaccgccttcagcaacagcttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaacagagggagcaagaaagtcaaatggctcgtcttaaaaaacagcaggaagaattggaacagatgagactacgttaccttgccgctgaggaaaaagatacagtaaaaaccgagcgacaagaattgttggatataagaaatgaattgaacaggttaaggcaacaagagcaaaaacaataccaggattccacagagattgcaagtggaaaaaaggatggcccccatggcagtgtattggaagaaggtttggatgattatttgactcgcctgatagaagaaagggatactttgatgagaacgggtgtgtataatcacgaggatcgaataataagtgaactcgaccgacagatcagagagattttggcaaaaagcaatgccagtaattaataacatttggaaaagctttatagagactctaagtctaaattttaatttctttgtaaaaacctcaaaagtgaggaaaatggatgttttaaaatggtattttcaattttttataagcaaaattttgtatgttattgtatagtatttatttgatcttatttactttatgctacctctcccacactggttttatttgtaatttgcatttatatactcattttaaatgacttttcagtgtttttcatagtttataatctgatggctaactaactttcaaaacagcttttaactaagtttgttgtaggagaaatgactgcggtaatttccagttctataatgtttcatgttgagccaaaagagtatatcttgcactttaaaaacgctgcgtcctattccatttgaatgtaaattcttaaaagttgagaccaattgtaaccagtttaactcattttagatgacctttttttcttataatatttgcaagtgacaagtttgaaaacaaagcaagatcagtgcagagaagccacatgacatgttgggtgacagattggtcatttatttaaataaagttaatacagattaaatttgtttcaagagctattgaattttcaaattttcagtgtatttataacttttaagaacatgaagtattagcttaatatagttttctctgttggtttcttcctcaagtttgcattgttttcttttgttaaaattagagatttctttttattttccagttatagtaatactagctgtcagcttaaaccctctgtaatagaacatggaaacagacacataaagacattagctgaaaaaatagagtgaaaatcaactattttttactcccgctaatttcaatcaatcgttttcaaaagcgcacgagattcactcattggatttatgcagtgccctgtctgtataaaaactcttaagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggaaggtctgcggtaaaatgctgtgactgtttactttcaattgcattgtgtgttgcctgtgactgctttcaaacgctagagggggcctctgatttaaagaaataaaaaggacttttctaaaatggatgtgtagtttattttgccttttgtaaagctcttttggctattgtaacttaacaaataaaatcataattgtgtgcatctctg

SEQ ID NO: 5408 - DNA, 4710 bp, Homo sapiens
tttacagcagtagtgcgcttgcgcagctggtcccacaccaagtcgcccgcctctcctcgtccggctagcagagggcgctgtgagccgccttcgcccccggaccgctcaccgcaaccatggtctccaaatccgaccaattgctcatcgtcgtgtccatcctagaaggtcggcatttccccaaacgtccaaagcatatgcttgtagtggaagcaaagtttgatggagaacagttggctactgatcctgtggaccacactgaccagccagaatttgctactgagttagcttgggaaattgacaggaaagcgcttcatcagcacaggctacagcgtactcctatcaaactccaatgttttgccttggatcctgtaacttcagccaaggaaaccataggttacatcgttctggatttaagaaccgctcaagaaacaaagcaggcaccaaaatggtaccagttgctgagtaataaatacaccaaattcaagtctgagatacagataagtattgctttggaaaccgatacaaagccaccagtggatagctttaaagcaaagggggctccccctcgagatggaaaagtacctgccatcctggctggacttgaccccagggacattgtggctgtgctgaatgaagagggaggctaccatcagattggaccagcagaatactgtactgactcctttattatgtcagtgaccatagcatttgctacccagttggaacagttaattccatgtaccatgaaacttccagaaagacagcctgagtttttcttttactactctttactgggaaatgatgttacaaatgaacccttcaatgatttaatcaacccaaactttgagccagagagagcatcagttcgcatccgtagcagtgtagaaattcttcgtgtttacctggctcttcagtctaaactgcagattcacctctgctgtggagaccagtcacttggaagtacagaaatacctttaactggattacttaaaaagggcagtacagaaatcaaccagcacccagtcacagtcgaaggtgcttttacccttgaccctccaaacagagccaaacagaagcttgcacctattcctgtggagctagccccaactgtgggagtgtctgtggctctgcagagagaaggcatagactcccagtctttaattgaattaaagacccagaatgaacatgagccagagcattcaaagaagaaagttttaacccccataaaggagaagacacttactgggccaaaatcaccaacagtgtcccctgttccatctcacaaccagtcacctccaacaaaagatgatgcaacagaaagtgaagtggaaagtttacagtatgataaggacaccaaaccaaatccaaaagccagttcttctgtacctgcttcactggcccagctagtgactacatccaatgcttcagaagtagcttcaggacagaagattgctgtaccagcaacatcacatcatttttgcttttcaatagacttaaggagtatacatgccttggagattggttttccaatcaactgtatattaaggtactcatatccattctttggaagtgcagctcctattatgactaatcctcctgtagaagttcggaaaaacatggaagtttttcttccccagtcttactgtgcatttgattttgcaactatgcctcatcagctgcaagacaccttcttaaggattccattactggttgaactatggcacaaggataaaatgagtaaagatttacttctgggaattgcgagaatccagctttctaacatcttgtcttcagaaaaaactcgttttttaggttctaatggtgaacagtgttggcgtcaaacttacagtgaaagtgtgcctgttatagcagcacaaggatcaaataacaggatagcagatctttcttacacagtgactctagaagattatggactagtaaaaatgcgtgagatttttatctctgattcatctcagggtgtatctgccgtacagcaaaagccgtcttctcttcctccagcaccttgtccttcagagatccagacagagcctcgtgaaacgttagaatacaaagcagcacttgagctagaaatgtggaaggagatgcaagaagatatatttgaaaatcagctgaagcagaaagaactggctcatatgcaggctcttgcagaggaatggaagaaaagggaccgagaaagagaatcactagtaaagaaaaaggtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactagaaaggttaaaaatcaaacagctcgaagaggataaacaccgccttcagcaacagcttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaacagagggagcaagaaagtcaaatggctcgtcttaaaaaacagcaggaagaattggaacagatgagactacgttaccttgccgctgaggaaaaagatacagtaaaaaccgagcgacaagaattgttggatataagaaatgaattgaacaggttaaggcaacaagagcaaaaacaataccaggattccacagagattgcaagtggaaaaaaggatggcccccatggcagtgtattggaagaaggtttggatgattatttgactcgcctgatagaagaaagggatactttgatgagaacgggtgtgtataatcacgaggatcgaataataagtgaactcgaccgacagatcagagagattttggcaaaaagcaatgccagtaattaataacatttggaaaagctttatagagactctaagtctaaattttaatttctttgtaaaaacctcaaaagtgaggaaaatggatgttttaaaatggtattttcaattttttataagcaaaattttgtatgttattgtatagtatttatttgatcttatttactttatgctacctctcccacactggttttatttgtaatttgcatttatatactcattttaaatgacttttcagtgtttttcatagtttataatctgatggctaactaactttcaaaacagcttttaactaagtttgttgtaggagaaatgactgcggtaatttccagttctataatgtttcatgttgagccaaaagagtatatcttgcactttaaaaacgctgcgtcctattccatttgaatgtaaattcttaaaagttgagaccaattgtaaccagtttaactcattttagatgacctttttttcttataatatttgcaagtgacaagtttgaaaacaaagcaagatcagtgcagagaagccacatgacatgttgggtgacagattggtcatttatttaaataaagttaatacagattaaatttgtttcaagagctattgaattttcaaattttcagtgtatttataacttttaagaacatgaagtattagcttaatatagttttctctgttggtttcttcctcaagtttgcattgttttcttttgttaaaattagagatttctttttattttccagttatagtaatactagctgtcagcttaaaccctctgtaatagaacatggaaacagacacataaagacattagctgaaaaaatagagtgaaaatcaactattttttactcccgctaatttcaatcaatcgttttcaaaagcgcacgagattcactcattggatttatgcagtgccctgtctgtataaaaactcttaagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggaaggtctgcggtaaaatgctgtgactgtttactttcaattgcattgtgtgttgcctgtgactgctttcaaacgctagagggggcctctgatttaaagaaataaaaaggacttttctaaaatggatgtgtagtttattttgccttttgtaaagctcttttggctattgtaacttaacaaataaaatcataattgtgtgcatctctg

SEQ ID NO: 5409 - DNA, 1259 bp, Homo sapiens
tttacagcagtagtgcgcttgcgcagctggtcccacaccaagtcgcccgcctctcctcgtccggctagcagagggcgctgtgagccgccttcgcccccggaccgctcaccgcaaccatggtctccaaatccgaccaattgctcatcgtcgtgtccatcctagaaggtcggcatttccccaaacgtccaaagcatatgcttgtagtggaagcaaagtttgatggagaacagttggctactgatcctgtggaccacactgaccagccagaatttgctactgagttagcttgggaaattgacaggaaagcgcttcatcagcacaggctacagcgtactcctatcaaactccaatgttttgccttggatcctgtaacttcagccaaggaaaccataggttacatcgttctggatttaagaaccgctcaagaaacaaagcaggcaccaaaatggtaccagttgctgagtaataaatacaccaaattcaagtctgagatacagataagtattgctttggaaaccgatacaaagccaccagtggatagctttaaagcaaagggggctccccctcgagatggaaaagtacctgccatcctggctggacttgaccccagggacattgtggctgtgctgaatgaagagggaggctaccatcagattggaccagcagaatactgtactgactcctttattatgtcagtgaccatagcatttgctacccagttggaacagttaattccatgtaccatgaaacttccagaaagacagcctgagtttttcttttactactctttactgggaaatgatgttacaaatgaacccttcaatgatttaatcaacccaaactttgagccagagagagcatcagttcgcatccgtagcagtgtagaaattcttcgtgtttacctggctcttcagtctaaactgcagattcacctctgctgtggagaccagtcacttggaagtacagaaatacctttaactggattacttaaaaagggcagtacagaaatcaaccagcacccagtcacagtcgaaggtgcttttacccttgaccctccaaacagagccaaacagaagcttgcacctattcctgtggagctagccccaactgtgggagtgtctgtggctctgcagagagaaggcatagactcccaggatgcattttggtattcagctctggatatcatatttcctctgttcatcttcctttttctggtcctagatgctataaggaaatttgcaaattacgaagaaaaatag

SEQ ID NO: 5410 - DNA, 4986 bp, Homo sapiens
gggatctgctagaagttggtcttccgccaggactagagtttcctcgcggtaacagcctccgtggcctccggaggaccatgtcattagactttggcagtgtggcactaccagtgcaaaatgaagatgaagagtatgacgaagaggactatgaaagagagaaagagttgcagcagttactcacagaccttccccatgacatgctggatgacgacctctcctctccagagctccagtattcggactgcagcgaggatggcacagacggacaaccacatcatcctgagcaattggagatgagctggaatgagcaaatgctgcccaaatctcaaagtgtaaatggtcccagttgtcaaggtttggaaccgtataataaagtgacatataaaccttatcagtcttctgcccagaataatggctcaccagcccaggagataacaggaagtgacacattcgaaggcctgcaacaacaatttttaggagctaatgagaactctgcagaaaatatgcagattattcaacttcaggttcttaacaaagcaaaagagagacaactggagaacttaattgaaaagttaaatgaaagtgaacgtcaaattcgatatctgaatcaccagcttgtaataataaaagatgaaaaggatggtttgactctcagccttcgagaatcacagaaactctttcagaatggaaaagaaagagagatacagcttgaagctcaaataaaagcactggagactcagatacaagcattaaaagtcaatgaagaacagatgatcaagaagtccagaacaactgaaatggctctggaaagcttgaagcagcagctggtggaccttcatcattctgaatcacttcaacgagctagagaacagcatgagagcattgttatgggcctcacaaagaagtacgaagagcaagtattgtccttacaaaagaatttggatgccacagtcaccgcacttaaagaacaggaagacatttgctctcgtctgaaagatcacgtgaaacaactggaaaggaatcaagaagcaatcaagttagaaaagactgagatcattaataagttgacaagaagtctagaggagagtcaaaagcagtgtgcccacttgttgcagtccgggtcagtacaagaggtggctcagctacagttccagctgcagcaagcacagaaggcacatgctatgagtgcaaacatgaacaaggctttgcaagaagaattaacagaactaaaagatgaaatttctctctatgaatctgctgcaaaactaggaatacatccaagtgactcagaaggagaattaaatatagaactcactgaatcgtatgtggatttgggtattaaaaaggtcaactggaaaaaatccaaagttaccagcattgtacaagaagaagacccaaatgaagagctttcaaaagatgagttcattctgaagttaaaggcagaagtacagcgtttgctgggtagcaactcaatgaagcgtcatctggtgtctcagttacaaaatgacctcaaagactgtcataagaaaattgaagatctccaccaagtgaagaaggatgaaaaaagcattgaggttgagactaaaacagatacctcagaaaaaccaaagaatcaattatggcctgagtcttctacttctgatgttgtcagagatgatattctgctgcttaaaaatgaaattcaagttttacaacaacaaaatcaggaacttaaagaaactgaaggaaaactgagaaatacaaatcaagacttatgtaatcaaatgagacaaatggtacaagattttgaccatgacaaacaagaagctgtggataggtgtgaaaggacttatcagcagcaccatgaagccatgaaaactcaaatacgtgaaagcctattagcaaagcatgctttggagaagcagcagctctttgaggcttatgagagaactcatttgcaactgaggtctgagttggataagttgaataaggaggtgactgctgtgcaggaatgttacctagaagtgtgcagagagaaggataatctagaattgactctcaggaagaccactgaaaaggagcaacagactcaggagaagatcaaagaaaaactcattcaacagcttgaaaaggagtggcagtctaagctggatcaaactataaaggcaatgaaaaagaagaccttagattgtggcagccaaactgaccaagtaaccaccagtgatgttatttccaagaaagagatggcaattatgatagaagagcagaagtgcacaatccagcaaaacttagaacaagagaaggacatagccatcaagggggctatgaagaaactcgaaattgaattggaactcaaacattgtgaaaatattaccaaacaggtagaaatagctgtgcaaaatgctcatcagcgatggctgggagaactaccagagctggcagagtatcaagcacttgtgaaggcagaacagaaaaagtgggaagaacagcatgaggtctctgtgaacaaaaggatatcatttgctgtttctgaagctaaagagaaatggaagagtgagcttgaaaatatgaggaaaaatatacttcctggaaaggaattggaagagaagattcattctcttcagaaggaacttgagttaaagaacgaagaagtccctgtggtcatcagggctgagttagctaaggctcggagtgaatggaacaaagaaaagcaagaagaaatccacagaatccaagaacaaaatgagcaagattaccggcaatttttagatgatcaccgaaataaaattaatgaggtgcttgcggcagctaaagaagactttatgaaacaaaaaactgaactacttcttcagaaggagacagaattacaaacttgtctagaccagagtcgtagagaatggactatgcaggaagccaagcggatccaactggaaatctatcagtatgaggaagacatcctgactgtacttggggttcttttaagtgatacccaaaaggagcacatcagtgattctgaggacaagcagcttttggaaatcatgtcgacttgttcttcaaaatggatgtctgtgcaatattttgaaaaactaaagggctgcatacagaaagcatttcaagatacacttcctctgcttgtagaaaacgctgacccagaatggaaaaagagaaatatggccgagctctctaaggattctgccagccagggcactggccaaggagaccctggacctgctgctggacaccatgctcagcccttggccttacaagcaacagaagcagaagctgataagaaaaaggtccttgaaattaaggatttatgctgtggacactgcttccaagaacttgaaaaggcaaagcaggaatgtcaagatctgaaaggaaaactggagaaatgctgtaggcatcttcagcatttagaaaggaagcacaaagctgtagtggaaaaaattggagaagagaataataaagttgttgaagaattaatagaagaaaacaacgacatgaagaataaattggaagaattgcaaacactttgtaaaacaccaccaaggtcattgtcagcaggggccattgaaaatgcttgcctgccatgcagtgggggagccttggaagaacttcgtgggcagtacattaaagctgtaaaaaaaattaaatgtgacatgcttcgttatattcaggagagtaaggaacgagctgcagaaatggtaaaagcagaggtactgcgagaacgtcaagaaaccgcccgaaagatgcgcaaatattatttgatttgcctccaacagattttgcaggatgatggaaaagaaggggctgagaaaaagattatgaatgctgctagcaaacttgctacaatggcaaaattactggaaacacctatttctagtaagtcccaaagcaaaactacacagtcaggtatgtcaaagtgagtcgccaaatggtttttctatcttttcttctttagctatttaatattttcagtatgaagaaggcagggaaggtaaggagtgagagttaatttgtgaagttttgtatgttttacttaaactagaagtttacgcaaaaagagtacacagtttccaatttaagtaggcagactgagcatgcccatcagtttcctattgctgcttccatccctcgaaatgatagaaaagattttaaacagcaaataaagaatgagaaaaagaagaaattataagtgggttttaaaaagttgcagtgggccaggcatcatggctcacacctgtaatcccagcactttgggaggctgaggtgggaggatcccttgatcccaggaatttgaggttgcagtaagctatgattgtgccactgtactccagcctgggtgacagagtgaggccctgtctcaaaaaaaaaaaaaaaaagtttgcagtggatagaccagaagctacaagaaatccctgagagaaagaagacagtataggatggaagatggaaacctcagttcaaaaccaccgggagatgactattgcaattaggagcaatatcaaaactgttccacatatgagggtgatatgttccaggagaaatagagggcctaggggatatgaatggggtaattagttggtgttctaaaccaacagcaaccaggtggggttaatcctctctttatttcttcttctcccctcctttccccaacctcaatattgagctgggcaacaacaacaggaacaaagaatctgggagcagggcagtgctccaggtggctagccatatcaagcaggaactgggagccgacttgccttgggaggctgagatgggaggatcacttgagtccgggaggtcaaggctgcagtgagctgtgatcgcaccactgcactccagcctgggaaacagagcagaccctgtctcaaaaaaaaaaaaaaaaaaaaaaaaaaaagtaagagtaaccaacaaaaacatagaacgtataactttaaaactggtaaaggaaaaacttggaaaaaaacattttcaatctaacaaaatcaggaaagaggaaaaaaacct

SEQ ID NO: 5411 - DNA, 5635 bp, Homo sapiens
ccgggcgagcttctagtcggcgattgaaggatgcgagtgctccttaagggcctccgccccgtgagttcggttgtgactaggaaggagctagtggactagagccagggtaaggggatctgctagaagttggtcttccgccaggactagagtttcctcgcggtaacagcctccgtggcctccggaggaccatgtcattagactttggcagtgtggcactaccagtgcaaaatgaagatgaagagtatgacgaagaggactatgaaagagagaaagagttgcagcagttactcacagaccttccccatgacatgctggatgacgacctctcctctccagagctccagtattcggactgcagcgaggatggcacagacggacaaccacatcatcctgagcaattggagatgagctggaatgagcaaatgctgcccaaatctcaaagtgtaaatggctataatgaaattcagagtttatatgctggagaaaaatgtggtaatgtctgggaagaaaatagaagtaaaactgaagaccgacatcctgtgtaccatcctgaagaaggtggagatgaaggtggaagtggttatagtcctccaagtaaatgtgaacagactgatttatatcaccttcctgaaaactttaggccatataccaatggtcagaagcaggaatttaataaccaagcaaccaatgtaattaaattttcagatcctcaatggaaccattttcagggtcccagttgtcaaggtttggaaccgtataataaagtgacatataaaccttatcagtcttctgcccagaataatggctcaccagcccaggagataacaggaagtgacacattcgaaggcctgcaacaacaatttttaggagctaatgagaactctgcagaaaatatgcagattattcaacttcaggttcttaacaaagcaaaagagagacaactggagaacttaattgaaaagttaaatgaaagtgaacgtcaaattcgatatctgaatcaccagcttgtaataataaaagatgaaaaggatggtttgactctcagccttcgagaatcacagaaactctttcagaatggaaaagaaagagagatacagcttgaagctcaaataaaagcactggagactcagatacaagcattaaaagtcaatgaagaacagatgatcaagaagtccagaacaactgaaatggctctggaaagcttgaagcagcagctggtggaccttcatcattctgaatcacttcaacgagctagagaacagcatgagagcattgttatgggcctcacaaagaagtacgaagagcaagtattgtccttacaaaagaatttggatgccacagtcaccgcacttaaagaacaggaagacatttgctctcgtctgaaagatcacgtgaaacaactggaaaggaatcaagaagcaatcaagttagaaaagactgagatcattaataagttgacaagaagtctagaggagagtcaaaagcagtgtgcccacttgttgcagtccgggtcagtacaagaggtggctcagctacagttccagctgcagcaagcacagaaggcacatgctatgagtgcaaacatgaacaaggctttgcaagaagaattaacagaactaaaagatgaaatttctctctatgaatctgctgcaaaactaggaatacatccaagtgactcagaaggagaattaaatatagaactcactgaatcgtatgtggatttgggtattaaaaaggtcaactggaaaaaatccaaagttaccagcattgtacaagaagaagacccaaatgaagagctttcaaaagatgagttcattctgaagttaaaggcagaagtacagcgtttgctgggtagcaactcaatgaagcgtcatctggtgtctcagttacaaaatgacctcaaagactgtcataagaaaattgaagatctccaccaagtgaagaaggatgaaaaaagcattgaggttgagactaaaacagatacctcagaaaaaccaaagaatcaattatggcctgagtcttctacttctgatgttgtcagagatgatattctgctgcttaaaaatgaaattcaagttttacaacaacaaaatcaggaacttaaagaaactgaaggaaaactgagaaatacaaatcaagacttatgtaatcaaatgagacaaatggtacaagattttgaccatgacaaacaagaagctgtggataggtgtgaaaggacttatcagcagcaccatgaagccatgaaaactcaaatacgtgaaagcctattagcaaagcatgctttggagaagcagcagctctttgaggcttatgagagaactcatttgcaactgaggtctgagttggataagttgaataaggaggtgactgctgtgcaggaatgttacctagaagtgtgcagagagaaggataatctagaattgactctcaggaagaccactgaaaaggagcaacagactcaggagaagatcaaagaaaaactcattcaacagcttgaaaaggagtggcagtctaagctggatcaaactataaaggcaatgaaaaagaagaccttagattgtggcagccaaactgaccaagtaaccaccagtgatgttatttccaagaaagagatggcaattatgatagaagagcagaagtgcacaatccagcaaaacttagaacaagagaaggacatagccatcaagggggctatgaagaaactcgaaattgaattggaactcaaacattgtgaaaatattaccaaacaggtagaaatagctgtgcaaaatgctcatcagcgatggctgggagaactaccagagctggcagagtatcaagcacttgtgaaggcagaacagaaaaagtgggaagaacagcatgaggtctctgtgaacaaaaggatatcatttgctgtttctgaagctaaagagaaatggaagagtgagcttgaaaatatgaggaaaaatatacttcctggaaaggaattggaagagaagattcattctcttcagaaggaacttgagttaaagaacgaagaagtccctgtggtcatcagggctgagttagctaaggctcggagtgaatggaacaaagaaaagcaagaagaaatccacagaatccaagaacaaaatgagcaagattaccggcaatttttagatgatcaccgaaataaaattaatgaggtgcttgcggcagctaaagaagactttatgaaacaaaaaactgaactacttcttcagaaggagacagaattacaaacttgtctagaccagagtcgtagagaatggactatgcaggaagccaagcggatccaactggaaatctatcagtatgaggaagacatcctgactgtacttggggttcttttaagtgatacccaaaaggagcacatcagtgattctgaggacaagcagcttttggaaatcatgtcgacttgttcttcaaaatggatgtctgtgcaatattttgaaaaactaaagggctgcatacagaaagcatttcaagatacacttcctctgcttgtagaaaacgctgacccagaatggaaaaagagaaatatggccgagctctctaaggattctgccagccagggcactggccaaggagaccctggacctgctgctggacaccatgctcagcccttggccttacaagcaacagaagcagaagctgataagaaaaaggtccttgaaattaaggatttatgctgtggacactgcttccaagaacttgaaaaggcaaagcaggaatgtcaagatctgaaaggaaaactggagaaatgctgtaggcatcttcagcatttagaaaggaagcacaaagctgtagtggaaaaaattggagaagagaataataaagttgttgaagaattaatagaagaaaacaacgacatgaagaataaattggaagaattgcaaacactttgtaaaacaccaccaaggtcattgtcagcaggggccattgaaaatgcttgcctgccatgcagtgggggagccttggaagaacttcgtgggcagtacattaaagctgtaaaaaaaattaaatgtgacatgcttcgttatattcaggagagtaaggaacgagctgcagaaatggtaaaagcagaggtactgcgagaacgtcaagaaaccgcccgaaagatgcgcaaatattatttgatttgcctccaacagattttgcaggatgatggaaaagaaggggctgagaaaaagattatgaatgctgctagcaaacttgctacaatggcaaaattactggaaacacctatttctagtaagtcccaaagcaaaactacacagtcagcactgcccctaacttcagagatgctgattgcagttaaaaaatcaaaaagaaatgatgtgaatcagaaaataccatgttgtattgaaagcaaatcaaatagtgtaaacaccatcaccagaactctgtgcgaacaagctcccaagaggagggcagcttgtaacttacaaaggctgttagagaactcagagcatcagagcataaagcatgtgggatccaaagagacacatttggaattccagtttggggatggtagttgcaagcacctaaacagtttgccaaggaatgtttctcctgagtttgttccttgtgaaggtgaaggaggctttggtttgcacaagaagaaagacctactcagtgataatggttctgaatcacttccgcattcagctgcatacccctttcttggaaccttaggaaataaaccctcacctagatgtacccctggtccttctgaatcaggatgcatgcatataacctttcgcgattctaatgaaagacttggtttaaaagtatataaatgcaatccactaatggaaagtgaaaatgctgcatctgagaaaagtcaaggtttggatgttcaggaacctccagtaaaagatggaggggaccttagtgactgcttgggctggccttccagcagtgcaaccttatcctttgacagtcgtgaagcatcatttgtacatggtaggccacaaggaactttggaaataccaagtgaatctgttaaatccaaacagttttcaccatccggttatctttcagatacagaggaaagtaatatgatttgtcaaacaatgaaatgtcagcgttatcaaactccatacctgtcagaagaaaccacgtatttggagccaggaaagatcagtgtgaattgtggacacccatctcgtcataaggctgatagattaaagtcagatttcaaaaaactgagcagtacattaccatcttcagtgtgtcagcagccttcaagaaaattaattgttccgctatctagccaacaagatagtggctttgatagcccatttgttaatctagactaattatggtacagtatttaagaagaatcattaatatattaacaaaaatggaagggaagacctcatactgaaaaaaattgtgagccctgcctcttttgagatgttttaataacatctgttatataagtaaagcattcttctaaaattgcttgagatatttatgttgccttaatattccaaaggcctgatggtgtatgtataatctgcttttgtgtggtgcttatttttggtttctaaaccatctatttttatacttataaattgactcactctgcagtgttaacttatttaaataaacttgcatatggtctgtagaa

SEQ ID NO: 5412 - DNA, 5097 bp, Homo sapiens
tcgcggtaacagcctccgtggcctccggaggaccatgtcattagactttggcagtgtggcactaccagtgcaaaatgaagatgaagagtatgacgaagaggactatgaaagagagaaagagttgcagcagttactcacagaccttccccatgacatgctggatgacgacctctcctctccagagctccagtattcggactgcagcgaggatggcacagacggacaaccacatcatcctgagcaattggagatgagctggaatgagcaaatgctgcccaaatctcaaagtgtaaatggctataatgaaattcagagtttatatgctggagaaaaatgtggtaatgtctgggaagaaaatagaagtaaaactgaagaccgacatcctgtgtaccatcctgaagaaggtggagatgaaggtggaagtggttatagtcctccaagtaaatgtgaacagactgatttatatcaccttcctgaaaactttaggccatataccaatggtcagaagcaggaatttaataaccaagcaaccaatgtaattaaattttcagatcctcaatggaaccattttcagggtcccagttgtcaaggtttggaaccgtataataaagtgacatataaaccttatcagtcttctgcccagaataatggctcaccagcccaggagataacaggaagtgacacattcgaaggcctgcaacaacaatttttaggagctaatgagaactctgcagaaaatatgcagattattcaacttcaggttcttaacaaagcaaaagagagacaactggagaacttaattgaaaagttaaatgaaagtgaacgtcaaattcgatatctgaatcaccagcttgtaataataaaagatgaaaaggatggtttgactctcagccttcgagaatcacagaaactctttcagaatggaaaagaaagagagatacagcttgaagctcaaataaaagcactggagactcagatacaagcattaaaagtcaatgaagaacagatgatcaagaagtccagaacaactgaaatggctctggaaagcttgaagcagcagctggtggaccttcatcattctgaatcacttcaacgagctagagaacagcatgagagcattgttatgggcctcacaaagaagtacgaagagcaagtattgtccttacaaaagaatttggatgccacagtcaccgcacttaaagaacaggaagacatttgctctcgtctgaaagatcacgtgaaacaactggaaaggaatcaagaagcaatcaagttagaaaagactgagatcattaataagttgacaagaagtctagaggagagtcaaaagcagtgtgcccacttgttgcagtccgggtcagtacaagaggtggctcagctacagttccagctgcagcaagcacagaaggcacatgctatgagtgcaaacatgaacaaggctttgcaagaagaattaacagaactaaaagatgaaatttctctctatgaatctgctgcaaaactaggaatacatccaagtgactcagaaggagaattaaatatagaactcactgaatcgtatgtggatttgggtattaaaaaggtcaactggaaaaaatccaaagttaccagcattgtacaagaagaagacccaaatgaagagctttcaaaagatgagttcattctgaagttaaaggcagaagtacagcgtttgctgggtagcaactcaatgaagcgtcatctggtgtctcagttacaaaatgacctcaaagactgtcataagaaaattgaagatctccaccaagtgaagaaggatgaaaaaagcattgaggttgagactaaaacagatacctcagaaaaaccaaagaatcaattatggcctgagtcttctacttctgatgttgtcagagatgatattctgctgcttaaaaatgaaattcaagttttacaacaacaaaatcaggaacttaaagaaactgaaggaaaactgagaaatacaaatcaagacttatgtaatcaaatgagacaaatggtacaagattttgaccatgacaaacaagaagctgtggataggtgtgaaaggacttatcagcagcaccatgaagccatgaaaactcaaatacgtgaaagcctattagcaaagcatgctttggagaagcagcagctctttgaggcttatgagagaactcatttgcaactgaggtctgagttggataagttgaataaggaggtgactgctgtgcaggaatgttacctagaagtgtgcagagagaaggataatctagaattgactctcaggaagaccactgaaaaggagcaacagactcaggagaagatcaaagaaaaactcattcaacagcttgaaaaggagtggcagtctaagctggatcaaactataaaggcaatgaaaaagaagaccttagattgtggcagccaaactgaccaagtaaccaccagtgatgttatttccaagaaagagatggcaattatgatagaagagcagaagtgcacaatccagcaaaacttagaacaagagaaggacatagccatcaagggggctatgaagaaactcgaaattgaattggaactcaaacattgtgaaaatattaccaaacaggtagaaatagctgtgcaaaatgctcatcagcgatggctgggagaactaccagagctggcagagtatcaagcacttgtgaaggcagaacagaaaaagtgggaagaacagcatgaggtctctgtgaacaaaaggatatcatttgctgtttctgaagctaaagagaaatggaagagtgagcttgaaaatatgaggaaaaatatacttcctggaaaggaattggaagagaagattcattctcttcagaaggaacttgagttaaagaacgaagaagtccctgtggtcatcagggctgagttagctaaggctcggagtgaatggaacaaagaaaagcaagaagaaatccacagaatccaagaacaaaatgagcaagattaccggcaatttttagatgatcaccgaaataaaattaatgaggtgcttgcggcagctaaagaagactttatgaaacaaaaaactgaactacttcttcagaaggagacagaattacaaacttgtctagaccagagtcgtagagaatggactatgcaggaagccaagcggatccaactggaaatctatcagtatgaggaagacatcctgactgtacttggggttcttttaagtgatacccaaaaggagcacatcagtgattctgaggacaagcagcttttggaaatcatgtcgacttgttcttcaaaatggatgtctgtgcaatattttgaaaaactaaagggctgcatacagaaagcatttcaagatacacttcctctgcttgtagaaaacgctgacccagaatggaaaaagagaaatatggccgagctctctaaggattctgccagccagggcactggccaaggagaccctggacctgctgctggacaccatgctcagcccttggccttacaagcaacagaagcagaagctgaagagaataataaagttgttgaagaattaatagaagaaaacaacgacatgaagaataaattggaagaattgcaaacactttgtaaaacaccaccaaggtcattgtcagcaggggccattgaaaatgcttgcctgccatgcagtgggggagccttggaagaacttcgtgggcagtacattaaagctgtaaaaaaaattaaatgtgacatgcttcgttatattcaggagagtaaggaacgagctgcagaaatggtaaaagcagaggtactgcgagaacgtcaagaaaccgcccgaaagatgcgcaaatattatttgatttgcctccaacagattttgcaggatgatggaaaagaaggggctgagaaaaagattatgaatgctgctagcaaacttgctacaatggcaaaattactggaaacacctatttctagtaagtcccaaagcaaaactacacagtcagcactgcccctaacttcagagatgctgattgcagttaaaaaatcaaaaagaaatgatgtgaatcagaaaataccatgttgtattgaaagcaaatcaaatagtgtaaacaccatcaccagaactctgtgcgaacaagctcccaagaggagggcagcttgtaacttacaaaggctgttagagaactcagagcatcagagcataaagcatgtgggatccaaagagacacatttggaattccagtttggggatggtagttgcaagcacctaaacagtttgccaaggaatgtttctcctgagtttgttccttgtgaaggtgaaggaggctttggtttgcacaagaagaaagacctactcagtgataatggttctgaatcacttccgcattcagctgcatacccctttcttggaaccttaggaaataaaccctcacctagatgtacccctggtccttctgaatcaggatgcatgcatataacctttcgcgattctaatgaaagacttggtttaaaagtatataaatgcaatccactaatggaaagtgaaaatgctgcatctgagaaaagtcaaggtttggatgttcaggaacctccagtaaaagatggaggggaccttagtgactgcttgggctggccttccagcagtgcaaccttatcctttgacagtcgtgaagcatcatttgtacatggtaggccacaaggaactttggaaataccaagtgaatctgttaaatccaaacagttttcaccatccggttatctttcagatacagaggaaagtaatatgatttgtcaaacaatgaaatgtcagcgttatcaaactccatacctgtcagaagaaaccacgtatttggagccaggaaagatcagtgtgaattgtggacacccatctcgtcataaggctgatagattaaagtcagatttcaaaaaactgagcagtacattaccatcttcagtgtgtcagcagccttcaagaaaattaattgttccgctatctagccaacaagatagtggctttgatagcccatttgttaatctagactaattatggtacagtatttaagaagaatcattaatatattaacaaaaatggaagggaagacctcatactgaaaaaaattgtgagccctgcctcttttgaga

SEQ ID NO: 5413 - DNA, 1896 bp, Homo sapiens
ggttgtgactaggaaggagctagtggactagagccagggtaaggggatctgctagaagttggtcttccgccaggactagagtttcctcgcggtaacagcctccgtggcctccggaggaccatgtcattagactttggcagtgtggcactaccagtgcaaaatgaagatgaagagtatgacgaagaggactatgaaagagagaaagagttgcagcagttactcacagaccttccccatgacatgctggatgacgacctctcctctccagagctccagtattcggactgcagcgaggatggcacagacggacaaccacatcatcctgagcaattggagatgagctggaatgagcaaatgctgcccaaatctcaaagtgtaaatggctataatgaaattcagagtttatatgctggagaaaaatgtggtaatgtctgggaagaaaatagaagtaaaactgaagaccgacatcctgtgtaccatcctgaagaaggtggagatgaaggtggaagtggttatagtcctccaagtaaatgtgaacagactgatttatatcaccttcctgaaaactttaggccatataccaatggtcagaagcaggaatttaataaccaagcaaccaatgtaattaaattttcagatcctcaatggaaccattttcagggtcccagttgtcaaggtttggaaccgtataataaagtgacatataaaccttatcagtcttctgcccagaataatggctcaccagcccaggagataacaggaagtgacacattcgaaggcctgcaacaacaatttttaggagctaatgagaactctgcagaaaatatgcagattattcaacttcaggttcttaacaaagcaaaagagagacaactggagaacttaattgaaaagttaaatgaaagtgaacgtcaaattcgatatctgaatcaccagcttgtaataataaaagatgaaaaggatggtttgactctcagccttcgagaatcacagaaactctttcagaatggaaaagaaagagagatacagcttgaagctcaaataaaagcactggagactcagatacaagcattaaaagtcaatgaagaacagatgatcaagaagtccagaacaactgaaatggctctggaaagcttgaagcagcagctggtggaccttcatcattctgaatcacttcaacgagctagagaacagcatgagagcattgttatgggcctcacaaagaagtacgaagagcaagtattgtccttacaaaagaatttggatgccacagtcaccgcacttaaagaacaggaagacatttgctctcgtctgaaagatcacgtgaaacaactggaaaggaatcaagaagcaatcaagttagaaaagactgagatcattaataagttgacaagaagtctagaggagagtcaaaagcagtgtgcccacttgttgcagtccgggtcagtacaagaggtggctcagctacagttccagctgcagcaagcacagaaggcacatgctatgagtgcaaacatgaacaaggctttgcaagaagaattaacagaactaaaagatgaaatttctctctatgaatctgctgcaaaactaggaatacatccaagtgactcagaaggagaattaaatatagaactcactgaatcgtatgtggatttgggtattaaaaaggtcaactggaaaaaatccaaagttaccagcattgtacaagaagaagacccaaatgaagagctttcaaaagatgagttcattctgaagttaaaggcagaagtacagcgtttgctgggtagcaactcaatgaagcgtcatctggtgtctcagttacaaaatgacctcaaagactgtcataagaaaattgaagatctccaccaagtgaaaaaaaaaaaaaaaaaaaaaaaa

SEQ ID NO: 5414 - DNA, 588 bp, Homo sapiens
agccccgggcatcctgggccccgtgcggctttggtcatgtttgtagtgccgtagctgacgccaaacagttcctcaaggtcattcgctcagcctgtggatgcttattgtgtattagcattactcgctccgccctctgggcaacttgaatcaatttgtccaaagtgctgttattagcactgatcacaagatgttgtgatcatttgtttatatgtctattttctttcccttcatcgtgtcctgttaaactttgtaatcttgaacagtgcttggtaaattgtcgaatgaatgaataaggtgtctccaccaggtgttgcaagtctaaaccgggctatgtgctctggctatttccattctagaaggcgagttatgtcagcaagaggaccatgtcattagactttggcagtgtggcactaccagtgcaaaatgaagatgaagagtatgacgaagaggactatgaaagagagaaagagttgcagcagttactcacagaccttccccatgacatgctggatgacgacctctcctctccagagctccagtattcggactgcagcgaggatggcacagacggacaaccacatcatcctg

SEQ ID NO: 5415 - DNA, 6828 bp, Homo sapiens
cacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttta

SEQ ID NO: 5416 - DNA, 6727 bp, Homo sapiens
ttggaactgggcaggaggggatagggtccggctcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttgtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttta

SEQ ID NO: 5417 - DNA, 6805 bp, Homo sapiens
ttggaactgggcaggaggggatagggtccggctcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttgtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttta

SEQ ID NO: 5418 - DNA, 1953 bp, Homo sapiens
gggcaagctggaaaagcgtgtgggtgagaccctcgcacaaccccttttcattgtctgtgtgtggcgcctgcgcagtaagggatcgttggaactgggcaggaggggatagggtccggctcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcagattgtggcagtgtcgccttttgtggttttatgattttcaaattgaatttaatgattacaccctttcccttcatagatcttttttcttttttttaa

SEQ ID NO: 5419 - DNA, 561 bp, Homo sapiens
gtcatgcaccctgcctggcgactgcaccccgtggaggctctggctctgtagtaaacccgggggaggagagagtggcttcctgtcggcttcattgtcctaggattcagatgtagggttttggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctg

SEQ ID NO: 5420 - DNA, 608 bp, Homo sapiens
gtgtggcgcctgcgcagtaagggatcgttggaactgggcaggaggggatagggtccggctcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagat

SEQ ID NO: 5421 - DNA, 593 bp, Homo sapiens
atgtgctccctgagtaggctgtgactatcactgaacttgattctcaccgtgattaatctagttcttgcctttgtgatgtaaaagtagtaatcctcctaaaatggacctttactttcataaagtaacttactacatgaggaaagatgtcctaacatgtgcttttcataaaaacgaagtgttgcagtgttttccctactacctaatggtagctacttaacggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaag

SEQ ID NO: 5422 - DNA, 4638 bp, Homo sapiens
gggcaagctggaaaagcgtgtgggtgagaccctcgcacaaccccttttcattgtctgtgtgtggcgcctgcgcagtaagggatcgttggaactgggcaggaggggatagggtccggctcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttgtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccggccatgctgtga

SEQ ID NO: 5423 - DNA, 8155 bp, Homo sapiens
cccggggcccgcttgcctcagcttcttgctgccgccagcacgctaagctccagtcggcgccgaaggagagcttcccgaccctcgtgtccagtagccgcaatcccaggctgggagggtgaggcgccgcgctctgccgcccccccgcccctcgctccctgtgtcctggcggatttgcacgtaatctatccgaaagcccagtcccacccgccacccgactctggagctcccattcttcaggaccctgctgaagtatcgcttctcagccgccttctccaggcgcagctgcattcgcttctcggtttttgcactcgctgtgcaccgagttactttcccggcccctcgttgacaccgttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggagacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtcttcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcagctcagccaaggagctactggagagcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatggatgcagctggaaacagagaaggagagagtatccctcctggagacactgctgcagacgcagaaggagctagcagatgccagccaacaactggaacgactgaggcaggacatgaaagtccagaaattaaaggagcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtggaggacttgaagtctcagctggtggcccaggatgactcccagaggctggtggagcaggaggttcaggagaagctgagagagacccaggagtataaccgaattcagaaggagctggagagagagaaagccagcctgactctgtcactgatggaaaaggaacagagactccttgttttacaagaagctgactctattcgacaacaagagctgagtgccctgcgccaggacatgcaggaggcccagggagaacagaaagagctcagtgctcagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagacagctctcccagaatcaggaagagaaatccaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggctctggagaaggagcggctacacagcccaggtgcaaccagcacagcagaactggggtccagaggggagcagggtgtgcagctgggagaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtggagcgagaacggaggaagctgaagagggaggccatgcgtgcggcccaggcagggtccctagagatcagcaaggccacggcttcttcacccacacagcaggatgggagaggacagaagaactcagatgccaagtgtgtggctgaactgcagaaagaggtggtcctgctgcaagctcagctgactttggagcggaagcagaagcaggactacatcacccgctcagcacagaccagccgtgagctagcaggcctgcaccacagcctctcacactcacttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagaagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttgcttgctccctatggaatcacccagaggggtgccttgccctggctgagggacatgtactgcctctcatctagaatttattttcctagcacttcaccacctccttcatcttctccttcaacaataaaccctgagatctttgcattc

SEQ ID NO: 5424 - DNA, 1419 bp, Homo sapiens
gttactttcccggcccctcgttgacaccgttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggtacatgatcctttgctctggaaaggagttgggcgtgggcttgtaggttccttgtgctttatggacagatagtgcaggataccagttacatattccatgatgaaatcctctaaagctaaaaaataaattttggctgaatctgaaaa

SEQ ID NO: 5425 - DNA, 8398 bp, Homo sapiens
cgttcgggcagcggcctcttgttacccgggaggaacccgaggcccagagaggggctgggacgcgtcgttagggcccggggcccgcttgcctcagcttcttgctgccgccagcacgctaagctccagtcggcgccgaaggagagcttcccgaccctcgtgtccagtagccgcaatcccaggctgggagggtgaggcgccgcgctctgccgcccccccgcccctcgctccctgtgtcctggcggatttgcacgtaatctatccgaaagcccagtcccacccgccacccgactctggagctcccattcttcaggaccctgctgaagtatcgcttctcagccgccttctccaggcgcagctgcattcgcttctcggtttttgcactcgctgtgcaccgagttactttcccggcccctcgttgacaccgttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggagacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtcttcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcagctcagccaaggagctactggagagcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccagatgcagctggaaacagagaaggagagagtatccctcctggagacactgctgcagacgcagaaggagctagcagatgccagccaacaactggaacgactgaggcaggacatgaaagtccagaaattaaaggagcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtggaggacttgaagtctcagctggtggcccaggatgactcccagaggctggtggagcaggaggttcaggagaagctgagagagacccaggagtataaccgaattcagaaggagctggagagagagaaagccagcctgactctgtcactgatggaaaaggaacagagactccttgttttacaagaagctgactctattcgacaacaagagctgagtgccctgcgccaggacatgcaggaggcccagggagaacagaaagagctcagtgctcagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagacagctctcccagaatcaggaagagaaatccaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggctctggagaaggagcggctacacagcccaggtgcaaccagcacagcagaactggggtccagaggggagcagggtgtgcagctgggagaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtggagcgagaacggaggaagctgaagagggaggccatgcgtgcggcccaggcagggtccctagagatcagcaaggccacggcttcttcacccacacagcaggatgggagaggacagaagaactcagatgccaagtgtgtggctgaactgcagaaagaggtggtcctgctgcaagctcagctgactttggagcggaagcagaagcaggactacatcacccgctcagcacagaccagccgtgagctagcaggcctgcaccacagcctctcacactcacttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagaagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttgcttgctccctatggaatcacccagaggggtgccttgccctggctgagggacatgtactgcctctcatctagaatttattttcctagcacttcaccacctccttcatcttctccttcaacaataaaccctgagatctttgcattcat

SEQ ID NO: 5426 - DNA, 702 bp, Homo sapiens
agcagcggctgccgcagctcaatcgcggagcaactagccgggcgtctgcgggagccgagcgtggttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagca

SEQ ID NO: 5427 - DNA, 2156 bp, Homo sapiens
ttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctgacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtcttcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatcc

SEQ ID NO: 5428 - DNA, 868 bp, Homo sapiens
cgcagggccttagcagcggctgccgcagctcaatcgcggagcaactagccgggcgtctgcgggagccgagcgtggtgaggttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggag

SEQ ID NO: 5429 - DNA, 2295 bp, Homo sapiens
cagtcccacccgccacccgactctggagctcccattcttcaggaccctgctgaagtatcgcttctcagccgccttctccaggcgcagctgcattcgcttctcggtttttgcactcgctgtgcaccgagttactttcccggcccctcgttgacaccgtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggagacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtctgcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaag

SEQ ID NO: 5430 - DNA, 7544 bp, Homo sapiens
ggcccgcggccgggtccagcttggtggttgcggtagtgagaggcctccgctggttgccaggcttggtctagaggtggagcacagtgaaagaattcaagatgccacctaatataaactggaaagaaataatgaaagttgacccagatgacctgccccgtcaagaagaactggcagataatttattgatttccttatccaaggtggaagtaaatgagctaaaaagtgaaaagcaagaaaatgtgatacaccttttcagaattactcagtcactaatgaagatgaaagctcaagaagtggagctggctttggaagaagtagaaaaagctggagaagaacaagcaaaatttgaaaatcaattaaaaactaaagtaatgaaactggaaaatgaactggagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaattggctcttcgaaatgaggaggcagaaaatgaaaacagcaaattaagaagagagaacaaacgtctaaagaaaaagaatgaacaactttgtcaggatattattgactaccagaaacaaatagattcacagaaagaaacacttttatcaagaagaggggaagacagtgactaccgatcacagttgtctaaaaaaaactatgagcttatccaatatcttgatgaaattcagactttaacagaagctaatgagaaaattgaagttcagaatcaagaaatgagaaaaaatttagaagagtctgtacaggaaatggagaagatgactgatgaatataatagaatgaaagctattgtgcatcagacagataatgtaatagatcagttaaaaaaagaaaacgatcattatcaacttcaagtgcaggagcttacagatcttctgaaatcaaaaaatgaagaagatgatccaattatggtagctgtcaatgcaaaagtagaagaatggaagctaattttgtcttctaaagatgatgaaattattgagtatcagcaaatgttacataacctaagggagaaacttaagaatgctcagcttgatgctgataaaagtaatgttatggctctacagcagggtatacaggaacgagacagtcaaattaagatgctcaccgaacaagtagaacaatatacaaaagaaatggaaaagaatacttgtattattgaagatttgaaaaatgagctccaaagaaacaaaggtgcttcaaccctttctcaacagactcatatgaaaattcagtcaacgttagacattttaaaagagaaaactaaagaggctgagagaacagctgaactggctgaggctgatgctagggaaaaggataaagaattagttgaggctctgaagaggttaaaagattatgaatcgggagtatatggtttagaagatgctgtcgttgaaataaagaattgtaaaaaccaaattaaaataagagatcgagagattgaaatattaacaaaggaaatcaataaacttgaattgaagatcagtgatttccttgatgaaaatgaggcacttagagagcgtgtgggccttgaaccaaagacaatgattgatttaactgaatttagaaatagcaaacacttaaaacagcagcagtacagagctgaaaaccagattcttttgaaagaggcaagtattgaaagtctagaggaagaacgacttgatctgaaaaaaaaaattcgtcaaatggctcaagaaagaggaaaaagaagtgcaacttcaggattaaccactgaggacctgaacctaactgaaaacatttctcaaggagatagaataagtgaaagaaaattggatttattgagcctcaaaaatatgagtgaagcacaatcaaagaatgaatttctttcaagagaactaattgaaaaagaaagagatttagaaaggagtaggacagtgatagccaaatttcagaataaattaaaagaattagttgaagaaaataagcaacttgaagaaggtatgaaagaaatattgcaagcaattaaggaaatgcagaaagatcctgatgttaaaggaggagaaacatctctaattatccctagccttgaaagactagttaatgctatagaatcaaagaatgcagaaggaatctttgatgcgagtctgcatttgaaagcccaagttgatcagcttaccggaagaaatgaagaattaagacaggagctcagggaatctcggaaagaggctataaattattcacagcagttggcaaaagctaatttaaagatagaccatcttgaaaaagaaactagtcttttacgacaatcagaaggatcaaatgttgtttttaaaggaattgacttacctgatgggatagcaccatctagtgccagtatcattaattctcagaatgaatatttaatacatttgttacaggaactagaaaataaagaaaaaaagttaaagaatttagaagattctcttgaagattacaacagaaaatttgctgtaattcgtcatcaacaaagtttgttgtataaagaatacctaagtgaaaaggagacctggaaaacagaatctaaaacaataaaagaggaaaagagaaaacttgaggatcaagtccaacaagatgctataaaagtaaaagaatataataatttgctcaatgctcttcagatggattcggatgaaatgaaaaaaatacttgcagaaaatagtaggaaaattactgttttgcaagtgaatgaaaaatcacttataaggcaatatacaaccttagtagaattggagcgacaacttagaaaagaaaatgagaagcaaaagaatgaattgttgtcaatggaggctgaagtttgtgaaaaaattgggtgtttgcaaagatttaaggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgagcttaccaaaatcaatttggatgcacagaaggtggaacagatgttaagagatgaattagctgatagtgtgagcaaggcagtaagtgatgctgataggcaacggattctagaattagagaagaatgaaatggaactaaaagttgaagtgtcaaaactgagagagatttctgatattgccagaagacaagttgaaattttgaatgcacaacaacaatctagggacaaggaagtagagtccctcagaatgcaactgctagactatcaggcacagtctgatgaaaagtcgctcattgccaagttgcaccaacataatgtctctcttcaactgagtgaggctactgctcttggtaagttggagtcaattacatctaaactgcagaagatggaggcctacaacttgcgcttagagcagaaacttgatgaaaaagaacaggctctctattatgctcgtttggagggaagaaacagagcaaaacatctgcgccaaacaattcagtctctacgacgacagtttagtggagctttacccttggcacaacaggaaaagttctccaaaacaatgattcaactacaaaatgacaaacttaagataatgcaagaaatgaaaaattctcaacaagaacatagaaatatggagaacaaaacattggagatggaattaaaattaaagggcctggaagagttaataagcactttaaaggataccaaaggagcccaaaaggtaatcaactggcatatgaaaatagaagaacttcgtcttcaagaacttaaactaaatcgggaattagtcaaggataaagaagaaataaaatatttgaataacataatttctgaatatgaacgtacaatcagcagtcttgaagaagaaattgtgcaacagaacaagtttcatgaagaaagacaaatggcctgggatcaaagagaagttgacctggaacgccaactagacatttttgaccgtcagcaaaatgaaatactaaatgcggcacaaaagtttgaagaagctacaggatcaatccctgaccctagtttgccccttccaaatcaacttgagatcgctctaaggaaaattaaggagaacattcgaataattctagaaacacgggcaacttgcaaatcactagaagagaaactaaaagagaaagaatctgctttaaggttagcagaacaaaatatactgtcaagagacaaagtaatcaatgaactgaggcttcgattgcctgccactgcagaaagagaaaagctcatagctgagctaggcagaaaagagatggaaccaaaatctcaccacacattgaaaattgctcatcaaaccattgcaaacatgcaagcaaggttaaatcaaaaagaagaagtattaaagaagtatcaacgtcttctagaaaaagccagagaggagcaaagagaaattgtgaagaaacatgaggaagaccttcatattcttcatcacagattagaactacaggctgatagttcactaaataaattcaaacaaacggcttgggatttaatgaaacagtctcccactccagttcctaccaacaagcattttattcgtctggctgagatggaacagacagtagcagaacaagatgactctctttcctcactcttggtcaaactaaagaaagtatcacaagatttggagagacaaagagaaatcactgaattaaaagtaaaagaatttgaaaatatcaaattacagcttcaagaaaaccatgaagatgaagtgaaaaaagtaaaagcggaagtagaggatttaaagtatcttctggaccagtcacaaaaggagtcacagtgtttaaaatctgaacttcaggctcaaaaagaagcaaattcaagagctccaacaactacaatgagaaatctagtagaacggctaaagagccaattagccttgaaggagaaacaacagaaagcacttagtcgggcacttttagaactccgggcagaaatgacagcagctgctgaagaacgtattatttctgcaacttctcaaaaagaggcccatctcaatgttcaacaaatcgttgatcgacatactagagagctaaagacacaagttgaagatttaaatgaaaatcttttaaaattgaaagaagcacttaaaacaagtaaaaacagagaaaactcactaactgataatttgaatgacttaaataatgaactgcaaaagaaacaaaaagcctataataaaatacttagagagaaagaggaaattgatcaagagaatgatgaactgaaaaggcaaattaaaagactaaccagtggattacagggcaaacccctgacagataataaacaaagtctaattgaagaactccaaaggaaagttaaaaaactagagaaccaattagagggaaaggtggaggaagtagacctaaaacctatgaaagaaaagaatgctaaagaagaattaattaggtgggaagaaggtaaaaagtggcaagccaaaatagaaggaattcgaaacaagttaaaagagaaagagggggaagtctttactttaacaaagcagttgaatactttgaaggatctttttgccaaagccgataaagagaaacttactttgcagaggaaactaaaaacaactggcatgactgttgatcaggttttgggaatacgagctttggagtcagaaaaagaattggaagaattaaaaaagagaaatcttgacttagaaaatgatatattgtatatgagggcccaccaagctcttcctcgagattctgttgtagaagatttacatttacaaaatagatacctccaagaaaaacttcatgctttagaaaaacagttttcaaaggatacatattctaagccttcaatttcaggaatagagtcagatgatcattgtcagagagaacaggagcttcagaaggaaaacttgaagttgtcatctgaaaatattgaactgaaatttcagcttgaacaagcaaataaagatttgccaagattaaagaatcaagtcagagatttgaaggaaatgtgtgaatttcttaagaaagaaaaagcagaagttcagcggaaacttggccatgttagagggtctggtagaagtggaaagacaatcccagaactggaaaaaaccattggtttaatgaaaaaagtagttgaaaaagtccagagagaaaatgaacagttgaaaaaagcatcaggaatattgactagtgaaaaaatggctaatattgagcaggaaaatgaaaaattgaaggctgaattagaaaaacttaaagctcatcttgggcatcagttgagcatgcactatgaatccaagaccaaaggcacagaaaaaattattgctgaaaatgaaaggcttcgtaaagaacttaaaaaagaaactgatgctgcagagaaattacggatagcaaagaataatttagagatattaaatgagaagatgacagttcaactagaagagactggtaagagattgcagtttgcagaaagcagaggtccacagcttgaaggtgctgacagtaagagctggaaatccattgtggttacaagaatgtatgaaaccaagttaaaagaattggaaactgatattgccaaaaaaaatcaaagcattactgaccttaaacagcttgtaaaagaagcaacagagagagaacaaaaagttaacaaatacaatgaagaccttgaacaacagattaagattcttaaacatgttcctgaaggtgctgagacagagcaaggccttaaacgggagcttcaagttcttagattagctaatcatcagctggataaagagaaagcagaattaatccatcagatagaagctaacaaggaccaaagtggagctgaaagcaccatacctgatgctgatcaactaaaggaaaaaataaaagatctagagacacagctcaaaatgtcagatctagaaaagcagcatttgaaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaa

SEQ ID NO: 5431 - DNA, 6699 bp, Homo sapiens
gatcattatcaacttcaagtgcaggagcttacagatcttctgaaatcaaaaaatgaagaagatgatccaattatggtagctgtcaatgcaaaagtagaagaatggaagctaattttgtcttctaaagatgatgaaattattgagtatcagcaaatgttacataacctaagggagaaacttaagaatgctcagcttgatgctgataaaagtaatgttatggctctacagcagggtatacaggaacgagacagtcaaattaagatgctcaccgaacaagtagaacaatatacaaaagaaatggaaaagaatacttgtattattgaagatttgaaaaatgagctccaaagaaacaaaggtgcttcaaccctttctcaacagactcatatgaaaattcagtcaacgttagacattttaaaagagaaaactaaagaggctgagagaacagctgaactggctgaggctgatgctagggaaaaggataaagaattagttgaggctctgaagaggttaaaagattatgaatcgggagtatatggtttagaagatgctgtcgttgaaataaagaattgtaaaaaccaaattaaaataagagatcgagagattgaaatattaacaaaggaaatcaataaacttgaattgaagatcagtgatttccttgatgaaaatgaggcacttagagagcgtgtgggccttgaaccaaagacaatgattgatttaactgaatttagaaatagcaaacacttaaaacagcagcagtacagagctgaaaaccagattcttttgaaagagattgaaagtctagaggaagaacgacttgatctgaaaaaaaaaattcgtcaaatggctcaagaaagaggaaaaagaagtgcaacttcaggattaaccactgaggacctgaacctaactgaaaacatttctcaaggagatagaataagtgaaagaaaattggatttattgagcctcaaaaatatgagtgaagcacaatcaaagaatgaaatcatagcacaggaattcttgatcaaagaagcagagtgtagaaatgcagatatagagcttgaacatcacagaagccaggcagaacagaatgaatttctttcaagagaactaattgaaaaagaaagagatttagaaaggagtaggacagtgatagccaaatttcagaataaattaaaagaattagttgaagaaaataagcaacttgaagaaggtatgaaagaaatattgcaagcaattaaggaaatgcagaaagatcctgatgttaaaggaggagaaacatctctaattatccctagccttgaaagactagttaatgctatagaatcaaagaatgcagaaggaatctttgatgcgagtctgcatttgaaagcccaagttgatcagcttaccggaagaaatgaagaattaagacaggagctcagggaatctcggaaagaggctataaattattcacagcagttggcaaaagctaatttaaagatagaccatcttgaaaaagaaactagtcttttacgacaatcagaaggatcaaatgttgtttttaaaggaattgacttacctgatgggatagcaccatctagtgccagtatcattaattctcagaatgaatatttaatacatttgttacaggaactagaaaataaagaaaaaaagttaaagaatttagaagattctcttgaagattacaacagaaaatttgctgtaattcgtcatcaacaaagtttgttgtataaagaatacctaagtgaaaaggagacctggaaaacagaatctaaaacaataaaagaggaaaagagaaaacttgaggatcaagtccaacaagatgctataaaagtaaaagaatataataatttgctcaatgctcttcagatggattcggatgaaatgaaaaaaatacttgcagaaaatagtaggaaaattactgttttgcaagtgaatgaaaaatcacttataaggcaatatacaaccttagtagaattggagcgacaacttagaaaagaaaatgagaagcaaaagaatgaattgttgtcaatggaggctgaagtttgtgaaaaaattgggtgtttgcaaagatttaaggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgagcttaccaaaatcaatttggatgcacagaaggtggaacagatgttaagagatgaattagctgatagtgtgagcaaggcagtaagtgatgctgataggcaacggattctagaattagagaagaatgaaatggaactaaaagttgaagtgtcaaaactgagagagatttctgatattgccagaagacaagttgaaattttgaatgcacaacaacaatctagggacaaggaagtagagtccctcagaatgcaactgctagactatcaggcacagtctgatgaaaagtcgctcattgccaagttgcaccaacataatgtctctcttcaactgagtgaggctactgctcttggtaagttggagtcaattacatctaaactgcagaagatggaggcctacaacttgcgcttagagcagaaacttgatgaaaaagaacaggctctctattatgctcgtttggagggaagaaacagagcaaaacatctgcgccaaacaattcagtctctacgacgacagtttagtggagctttacccttggcacaacaggaaaagttctccaaaacaatgattcaactacaaaatgacaaacttaagataatgcaagaaatgaaaaattctcaacaagaacatagaaatatggagaacaaaacattggagatggaattaaaattaaagggcctggaagagttaataagcactttaaaggataccaaaggagcccaaaaggtaatcaactggcatatgaaaatagaagaacttcgtcttcaagaacttaaactaaatcgggaattagtcaaggataaagaagaaataaaatatttgaataacataatttctgaatatgaacgtacaatcagcagtcttgaagaagaaattgtgcaacagaacaagtttcatgaagaaagacaaatggcctgggatcaaagagaagttgacctggaacgccaactagacatttttgaccgtcagcaaaatgaaatactaaatgcggcacaaaagtttgaagaagctacaggatcaatccctgaccctagtttgccccttccaaatcaacttgagatcgctctaaggaaaattaaggagaacattcgaataattctagaaacacgggcaacttgcaaatcactagaagagaaactaaaagagaaagaatctgctttaaggttagcagaacaaaatatactgtcaagagacaaagtaatcaatgaactgaggcttcgattgcctgccactgcagaaagagaaaagctcatagctgagctaggcagaaaagagatggaaccaaaatctcaccacacattgaaaattgctcatcaaaccattgcaaacatgcaagcaaggttaaatcaaaaagaagaagtattaaagaagtatcaacgtcttctagaaaaagccagagaggagcaaagagaaattgtgaagaaacatgaggaagaccttcatattcttcatcacagattagaactacaggctgatagttcactaaataaattcaaacaaacggcttgggatttaatgaaacagtctcccactccagttcctaccaacaagcattttattcgtctggctgagatggaacagacagtagcagaacaagatgactctctttcctcactcttggtcaaactaaagaaagtatcacaagatttggagagacaaagagaaatcactgaattaaaagtaaaagaatttgaaaatatcaaattacagcttcaagaaaaccatgaagatgaagtgaaaaaagtaaaagcggaagtagaggatttaaagtatcttctggaccagtcacaaaaggagtcacagtgtttaaaatctgaacttcaggctcaaaaagaagcaaattcaagagctccaacaactacaatgagaaatctagtagaacggctaaagagccaattagccttgaaggagaaacaacagaaagcacttagtcgggcacttttagaactccgggcagaaatgacagcagctgctgaagaacgtattatttctgcaacttctcaaaaagaggcccatctcaatgttcaacaaatcgttgatcgacatactagagagctaaagacacaagttgaagatttaaatgaaaatcttttaaaattgaaagaagcacttaaaacaagtaaaaacagagaaaactcactaactgataatttgaatgacttaaataatgaactgcaaaagaaacaaaaagcctataataaaatacttagagagaaagaggaaattgatcaagagaatgatgaactgaaaaggcaaattaaaagactaaccagtggattacagggcaaacccctgacagataataaacaaagtctaattgaagaactccaaaggaaagttaaaaaactagagaaccaattagagggaaaggtggaggaagtagacctaaaacctatgaaagaaaagaatgctaaagaagaattaattaggtgggaagaaggtaaaaagtggcaagccaaaatagaaggaattcgaaacaagttaaaagagaaagagggggaagtctttactttaacaaagcagttgaatactttgaaggatctttttgccaaagccgataaagagaaacttactttgcagaggaaactaaaaacaactggcatgactgttgatcaggttttgggaatacgagctttggagtcagaaaaagaattggaagaattaaaaaagagaaatcttgacttagaaaatgatatattgtatatgagggcccaccaagctcttcctcgagattctgttgtagaagatttacatttacaaaatagatacctccaagaaaaacttcatgctttagaaaaacagttttcaaaggatacatattctaagccttcaatttcaggaatagagtcagatgatcattgtcagagagaacaggagcttcagaaggaaaacttgaagttgtcatctgaaaatattgaactgaaatttcagcttgaacaagcaaataaagatttgccaagattaaagaatcaagtcagagatttgaaggaaatgtgtgaatttcttaagaaagaaaaagcagaagttcagcggaaacttggccatgttagagggtctggtagaagtggaaagacaatcccagaactggaaaaaaccattggtttaatgaaaaaagtagttgaaaaagtccagagagaaaatgaacagttgaaaaaagcatcaggaatattgactagtgaaaaaatggctaatattgagcaggaaaatgaaaaattgaaggctgaattagaaaaacttaaagctcatcttgggcatcagttgagcatgcactatgaatccaagaccaaaggcacagaaaaaattattgctgaaaatgaaaggcttcgtaaagaacttaaaaaagaaactgatgctgcagagaaattacggatagcaaagaataatttagagatattaaatgagaagatgacagttcaactagaagagactggtaagagattgcagtttgcagaaagcagaggtccacagcttgaaggtgctgacagtaagagctggaaatccattgtggttacaagaatgtatgaaaccaagttaaaagaattggaaactgatattgccaaaaaaaatcaaagcattactgaccttaaacagcttgtaaaagaagcaacagagagagaacaaaaagttaacaaatacaatgaagaccttgaacaacagattaagattcttaaacatgttcctgaaggtgctgagacagagcaaggccttaaacgggagcttcaagttcttagattagctaatcatcagctggataaagagaaagcagaattaatccatcagatagaagctaacaaggaccaaagtggagctgaaagcaccatacctgatgctgatcaactaaaggaaaaaataaaagatctagagacacagctcaaaatgtcagatctagaaaagcagcatttgaaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaa

SEQ ID NO: 5432 - DNA, 2826 bp, Homo sapiens
ggcccgcggccgggtccagcttggtggttgcggtagtgagaggcctccgctggttgccaggcttggtctagaggtggagcacagtgaaagaattcaagatgccacctaatataaactggaaagaaataatgaaagttgacccagatgacctgccccgtcaagaagaactggcagataatttattgatttccttatccaaggtggaagtaaatgagctaaaaagtgaaaagcaagaaaatgtgatacaccttttcagaattactcagtcactaatgaagatgaaagctcaagaagtggagctggctttggaagaagtagaaaaagctggagaagaacaagcaaaatttgaaaatcaattaaaaactaaagtaatgaaactggaaaatgaactggagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaattggctcttcgaaatgaggaggcagaaaatgaaaacagcaaattaagaagagagaacaaacgtctaaagaaaaagaatgaacaactttgtcaggatattattgactaccagaaacaaatagattcacagaaagaaacacttttatcaagaagaggggaagacagtgactaccgatcacagttgtctaaaaaaaactatgagcttatccaatatcttgatgaaattcagactttaacagaagctaatgagaaaattgaagttcagaatcaagaaatgagaaaaaatttagaagagtctgtacaggaaatggagaagatgactgatgaatataatagaatgaaagctattgtgcatcagacagataatgtaatagatcagttaaaaaaagaaaacgatcattatcaacttcaagtgcaggagcttacagatcttctgaaatcaaaaaatgaagaagatgatccaattatggtagctgtcaatgcaaaagtagaagaatggaagctaattttgtcttctaaagatgatgaaattattgagtatcagcaaatgttacataacctaagggagaaacttaagaatgctcagcttgatgctgataaaagtaatgttatggctctacagcagggtatacaggaacgagacagtcaaattaagatgctcaccgaacaagtagaacaatatacaaaagaaatggaaaagaatacttgtattattgaagatttgaaaaatgagctccaaagaaacaaaggtgcttcaaccctttctcaacagactcatatgaaaattcagtcaacgttagacattttaaaagagaaaactaaagaggctgagagaacagctgaactggctgaggctgatgctagggaaaaggataaagaattagttgaggctctgaagaggttaaaagattatgaatcgggagtatatggtttagaagatgctgtcgttgaaataaagaattgtaaaaaccaaattaaaataagagatcgagagattgaaatattaacaaaggaaatcaataaacttgaattgaagatcagtgatttccttgatgaaaatgaggcacttagagagcgtgtgggccttgaaccaaagacaatgattgatttaactgaatttagaaatagcaaacacttaaaacagcagcagtacagagctgaaaaccagattcttttgaaagagattgaaagtctagaggaagaacgacttgatctgaaaaaaaaaattcgtcaaatggctcaagaaagaggaaaaagaagtgcaacttcaggattaaccactgaggacctgaacctaactgaaaacatttctcaaggagatagaataagtgaaagaaaattggatttattgagcctcaaaaatatgagtgaagcacaatcaaagaatgaatttctttcaagagaactaattgaaaaagaaagagatttagaaaggagtaggacagtgatagccaaatttcagaataaattaaaagaattagttgaagaaaataagcaacttgaagaaggtatgaaagaaatattgcaagcaattaaggaaatgcagaaagatcctgatgttaaaggaggagaaacatctctaattatccctagccttgaaagactagttaatgctatagaatcaaagaatgcagaaggaatctttgatgcgagtctgcatttgaaagcccaagttgatcagcttaccggaagaaatgaagaattaagacaggagctcagggaatctcggaaagaggctataaattattcacagcagttggcaaaagctaatttaaagatagaccatcttgaaaaagaaactagtcttttacgacaatcagaaggatcaaatgttgtttttaaaggaattgacttacctgatgggatagcaccatctagtgccagtatcattaattctcagaatgaatatttaatacatttgttacaggaactagaaaataaagaaaaagttaaagaatttagaagattctcttgaagattacaacagaaaatttgctgtaattcgtcatcaacaaagtttgttgtataaagaatacctaagtgaaaaggagacctggaaaacagaatctaaaacaataaaagaggaaaagagaaaacttgaggatcaagtccaacaagatgctataaaagtaaaagaatataataatttgctcaatgctcttcagatggattcggatgaaatgaaaaaaatacttgcagaaaatagtaggaaaattactgttttgcaagtgaatgaaaaatcacttataaggcaatatacaaccttagtagaattggagcgacaactt

SEQ ID NO: 5433 - DNA, 1935 bp, Homo sapiens
aagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaattggctcttcgaaatgaggaggcagaaaatgaaaacagcaaattaagaagagagaacaaacgtctaaagaaaaagaatgaacaactttgtcaggatattattgactaccagaaacaaatagattcacagaaagaaacacttttatcaagaagaggggaagacagtgactaccgatcacagttgtctaaaaaaaactatgagcttatccaatatcttgatgaaattcagactttaacagaagctaatgagaaaattgaagttcagaatcaagaaatgagaaaaaatttagaagagtctgtacaggaaatggagaagatgactgatgaatataatagaatgaaagctattgtgcatcagacagataatgtaatagatcagttaaaaaaagaaaacgatcattatcaacttcaagtgcaggagcttacagatcttctgaaatcaaaaaatgaagaagatgatccaattatggtagctgtcaatgcaaaagtagaagaatggaagctaattttgtcttctaaagatgatgaaattattgagtatcagcaaatgttacataacctaagggagaaacttaagaatgctcagcttgatgctgataaaagtaatgttatggctctacagcagggtatacaggaacgagacagtcaaattaagatgctcaccgaacaagtagaacaatatacaaaagaaatggaaaagaatacttgtattattgaagatttgaaaaatgagctccaaagaaacaaaggtgcttcaaccctttctcaacagactcatatgaaaattcagtcaacgttagacattttaaaagagaaaactaaagaggctgagagaacagctgaactggctgaggctgatgctagggaaaaggataaagaattagttgaggctctgaagaggttaaaagattatgaatcgggagtatatggtttagaagatgctgtcgttgaaataaagaattgtaaaaaccaaattaaaataagagatcgagagattgaaatattaacaaaggaaatcaataaacttgaattgaagatcagtgatttccttgatgaaaatgaggcacttagagagcgtgtgggccttgaaccaaagacaatgattgatttaactgaatttagaaatagcaaacacttaaaacagcagcagtacagagctgaaaaccagattcttttgaaagagattgaaagtctagaggaagaacgacttgatctgaaaaaaaaaattcgtcaaatggctcaagaaagaggaaaaagaagtgcaacttcaggattaaccactgaggacctgaacctaactgaaaacatttctcaaggagatagaataagtgaaagaaaattggatttattgagcctcaaaaatatgagtgaagcacaatcaaagaatgaatttctttcaagagaactaattgaaaaagaaagagatttagaaaggagtaggacagtgatagccaaatttcagaataaatgctatagaatcaaagaatgcagaaggaatctttgatgcgagtctgcatttgaaagcccaagttgatcagcttaccggaagaaatgaagaattaagacaggagctcagggaatctcggaaagaggctataaattattcacagcagttggcaaaagctaatttaaagatagaccatcttgaaaaagaaactagtcttttacgacaatcagaaggatcaaatgttgtttttaaaggaattgacttacctgatgggatagcaccatctagtgccagtatcattaattctcagaatgaatatttaatacatttgttacaggtatt

SEQ ID NO: 5434 - DNA, 5967 bp, Homo sapiens
aagcttaatactgagcatcaagaaattctttaataaatataagtgatatttattcagacatgtaataaggaaatgttcatgtcttatttttgtgttagatttttttagaatctacttttgttagagttttataaatacagttagtgtttgagatagaaagagaaaagaattagttttcttcctcttctacctgctcatgaacttgatttttttctcccaacaattgaagagccaagaaaaagggagattcttaagagatgggaaatagaatctcatctacccctgtttcccccagaacagtgaaactgaatcttaagggtaagatagaatagtgtgtacttaacttagatggagaagaaaggctgccaaaatgagatctgaagcgctattacaaatatttccatcgttactgtacttcagaatgaattacaaccgtaagtttttttacttcctcattcataaatttgattattccttataccacttctcagctttcatcattctttattgtacttttctatgtaatgtttgcctattatacagcaacttaagagaactgtaagtttggacatttcattttggtgttgataatagaatatctttgaatagttctatagttgatgagtagaaccatgaaccaagtaacttaaagtccttgatgttatttattacagagaactataatagaagctctcccgctaatgtttccatcatgtgtacaaaaagttttcttgttattaaagctagtccgtttaacttacaataagcataaatagctaagctgtgaaagttacctgtgataatgctaattttcccatttattaaaaggcaagttgttttccgatcataagaaatttagaaaagccatccaaagataaattccgagtgatatattcctgctgtttgttatgttttctcaaattaattgagttttattttacaatgacaggagttattaaagtattttatttttattatgattaagattttcaaagtaacatttcttatatgaaagaaattatgttaatgcatgtttttcttacatgggaaatcatatattttaaaaatgattttaaaattcgttttactttaagttgtattatctttctcaaaagtggctagtgcttgaccagaaaaaaagacaccagcataactcagtgtatctttatttacataggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgagcttaccaaaatcaatttggatgcacagaaggtggaacagatgttaagagatgaattagctgatagtgtgagcaaggcagtaagtgatgctgataggcaacggattctagaattagagaagaatgaaatggaactaaaagttgaagtgtcaaaactgagagagatttctgatattgccagaagacaagttgaaattttgaatgcacaacaacaatctagggacaaggaagtagagtccctcagaatgcaactgctagactatcaggcacagtctgatgaaaagtcgctcattgccaagttgcaccaacataatgtctctcttcaactgagtgaggctactgctcttggtaagttggagtcaattacatctaaactgcagaagatggaggcctacaacttgcgcttagagcagaaacttgatgaaaaagaacaggctctctattatgctcgtttggagggaagaaacagagcaaaacatctgcgccaaacaattcagtctctacgacgacagtttagtggagctttacccttggcacaacaggaaaagttctccaaaacaatgattcaactacaaaatgacaaacttaagataatgcaagaaatgaaaaattctcaacaagaacatagaaatatggagaacaaaacattggagatggaattaaaattaaagggcctggaagagttaataagcactttaaaggataccaaaggagcccaaaaggtaatcaactggcatatgaaaatagaagaacttcgtcttcaagaacttaaactaaatcgggaattagtcaaggataaagaagaaataaaatatttgaataacataatttctgaatatgaacgtacaatcagcagtcttgaagaagaaattgtgcaacagaacaagtttcatgaagaaagacaaatggcctgggatcaaagagaagttgacctggaacgccaactagacatttttgaccgtcagcaaaatgaaatactaaatgcggcacaaaagtttgaagaagctacaggatcaatccctgaccctagtttgccccttccaaatcaacttgagatcgctctaaggaaaattaaggagaacattcgaataattctagaaacacgggcaacttgcaaatcactagaagagaaactaaaagagaaagaatctgctttaaggttagcagaacaaaatatactgtcaagagacaaagtaatcaatgaactgaggcttcgattgcctgccactgcagaaagagaaaagctcatagctgagctaggcagaaaagagatggaaccaaaatctcaccacacattgaaaattgctcatcaaaccattgcaaacatgcaagcaaggttaaatcaaaaagaagaagtattaaagaagtatcaacgtcttctagaaaaagccagagaggagcaaagagaaattgtgaagaaacatgaggaagaccttcatattcttcatcacagattagaactacaggctgatagttcactaaataaattcaaacaaacggcttgggatttaatgaaacagtctcccactccagttcctaccaacaagcattttattcgtctggctgagatggaacagacagtagcagaacaagatgactctctttcctcactcttggtcaaactaaagaaagtatcacaagatttggagagacaaagagaaatcactgaattaaaagtaaaagaatttgaaaatatcaaattacagcttcaagaaaaccatgaagatgaagtgaaaaaagtaaaagcggaagtagaggatttaaagtatcttctggaccagtcacaaaaggagtcacagtgtttaaaatctgaacttcaggctcaaaaagaagcaaattcaagagctccaacaactacaatgagaaatctagtagaacggctaaagagccaattagccttgaaggagaaacaacagaaagcacttagtcgggcacttttagaactccgggcagaaatgacagcagctgctgaagaacgtattatttctgcaacttctcaaaaagaggcccatctcaatgttcaacaaatcgttgatcgacatactagagagctaaagacacaagttgaagatttaaatgaaaatcttttaaaattgaaagaagcacttaaaacaagtaaaaacagagaaaactcactaactgataatttgaatgacttaaataatgaactgcaaaagaaacaaaaagcctataataaaatacttagagagaaagaggaaattgatcaagagaatgatgaactgaaaaggcaaattaaaagactaaccagtggattacagggcaaacccctgacagataataaacaaagtctaattgaagaactccaaaggaaagttaaaaaactagagaaccaattagagggaaaggtggaggaagtagacctaaaacctatgaaagaaaagaatgctaaagaagaattaattaggtgggaagaaggtaaaaagtggcaagccaaaatagaaggaattcgaaacaagttaaaagagaaagagggggaagtctttactttaacaaagcagttgaatactttgaaggatctttttgccaaagccgataaagagaaacttactttgcagaggaaactaaaaacaactggcatgactgttgatcaggttttgggaatacgagctttggagtcagaaaaagaattggaagaattaaaaaagagaaatcttgacttagaaaatgatatattgtatatgagggcccaccaagctcttcctcgagattctgttgtagaagatttacatttacaaaatagatacctccaagaaaaacttcatgctttagaaaaacagttttcaaaggatacatattctaagccttcaatttcaggaatagagtcagatgatcattgtcagagagaacaggagcttcagaaggaaaacttgaagttgtcatctgaaaatattgaactgaaatttcagcttgaacaagcaaataaagatttgccaagattaaagaatcaagtcagagatttgaaggaaatgtgtgaatttcttaagaaagaaaaagcagaagttcagcggaaacttggccatgttagagggtctggtagaagtggaaagacaatcccagaactggaaaaaaccattggtttaatgaaaaaagtagttgaaaaagtccagagagaaaatgaacagttgaaaaaagcatcaggaatattgactagtgaaaaaatggctaatattgagcaggaaaatgaaaaattgaaggctgaattagaaaaacttaaagctcatcttgggcatcagttgagcatgcactatgaatccaagaccaaaggcacagaaaaaattattgctgaaaatgaaaggcttcgtaaagaacttaaaaaagaaactgatgctgcagagaaattacggatagcaaagaataatttagagatattaaatgagaagatgacagttcaactagaagagactggtaagagattgcagtttgcagaaagcagaggtccacagcttgaaggtgctgacagtaagagctggaaatccattgtggttacaagaatgtatgaaaccaagttaaaagaattggaaactgatattgccaaaaaaaatcaaagcattactgaccttaaacagcttgtaaaagaagcaacagagagagaacaaaaagttaacaaatacaatgaagaccttgaacaacagattaagattcttaaacatgttcctgaaggtgctgagacagagcaaggccttaaacgggagcttcaagttcttagattagctaatcatcagctggataaagagaaagcagaattaatccatcagatagaagctaacaaggaccaaagtggagctgaaagcaccatacctgatgctgatcaactaaaggaaaaaataaaagatctagagacacagctcaaaatgtcagatctagaaaagcagcatttgaaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagttaaatatacttggaaataagcagttctccgaactgtagtatttccttctcactaccttgtacctttatacttagattggaattcttaataaataaaattatatgaaattttcaactt

SEQ ID NO: 5435 - DNA, 7948 bp, Homo sapiens
atttgaagtcctcgttccacgccttctcatcatcctgaacaccgagctctgggactccggcggagaatctaaacgtaaagcatcacccacggtcgtgaactgtaggctctcctggcatccgggatcttattctggccttggcggagttggggatggtgtcgcctagcagccgctgccgctttggcttgctcgggaccatttggctggacccagagtccgcgtggaaccgcgatagggatctgtcagggcccgcggccgggtccagcttggtggttgcggtagtgagaggcctccgctggttgccaggcttggtctagaggtggagcacagtgaaagaattcaagatgccacctaatataaactggaaagaaataatgaaagttgacccagatgacctgccccgtcaagaagaactggcagataatttattgatttccttatccaaggtggaagtaaatgagctaaaaagtgaaaagcaagaaaatgtgatacaccttttcagaattactcagtcactaatgaagatgaaagctcaagaagtggagctggctttggaagaagtagaaaaagctggagaagaacaagcaaaatttgaaaatcaattaaaaactaaagtaatgaaactggaaaatgaactggagatggctcagcagtctgcaggtggacgagatactcggtttttacgtaatgaaatttgccaacttgaaaaacaattagaacaaaaagatagagaattggaggacatggaaaaggagttggagaaagagaagaaagttaatgagcaattggctcttcgaaatgaggaggcagaaaatgaaaacagcaaattaagaagagagaacaaacgtctaaagaaaaagaatgaacaactttgtcaggatattattgactaccagaaacaaatagattcacagaaagaaacacttttatcaagaagaggggaagacagtgactaccgatcacagttgtctaaaaaaaactatgagcttatccaatatcttgatgaaattcagactttaacagaagctaatgagaaaattgaagttcagaatcaagaaatgagaaaaaatttagaagagtctgtacaggaaatggagaagatgactgatgaatataatagaatgaaagctattgtgcatcagacagataatgtaatagatcagttaaaaaaagaaaacgatcattatcaacttcaagtgcaggagcttacagatcttctgaaatcaaaaaatgaagaagatgatccaattatggtagctgtcaatgcaaaagtagaagaatggaagctaattttgtcttctaaagatgatgaaattattgagtatcagcaaatgttacataacctaagggagaaacttaagaatgctcagcttgatgctgataaaagtaatgttatggctctacagcagggtatacaggaacgagacagtcaaattaagatgctcaccgaacaagtagaacaatatacaaaagaaatggaaaagaatacttgtattattgaagatttgaaaaatgagctccaaagaaacaaaggtgcttcaaccctttctcaacagactcatatgaaaattcagtcaacgttagacattttaaaagagaaaactaaagaggctgagagaacagctgaactggctgaggctgatgctagggaaaaggataaagaattagttgaggctctgaagaggttaaaagattatgaatcgggagtatatggtttagaagatgctgtcgttgaaataaagaattgtaaaaaccaaattaaaataagagatcgagagattgaaatattaacaaaggaaatcaataaacttgaattgaagatcagtgatttccttgatgaaaatgaggcacttagagagcgtgtgggccttgaaccaaagacaatgattgatttaactgaatttagaaatagcaaacacttaaaacagcagcagtacagagctgaaaaccagattcttttgaaagagattgaaagtctagaggaagaacgacttgatctgaaaaaaaaaattcgtcaaatggctcaagaaagaggaaaaagaagtgcaacttcaggattaaccactgaggacctgaacctaactgaaaacatttctcaaggagatagaataagtgaaagaaaattggatttattgagcctcaaaaatatgagtgaagcacaatcaaagaatgaatttctttcaagagaactaattgaaaaagaaagagatttagaaaggagtaggacagtgatagccaaatttcagaataaattaaaagaattagttgaagaaaataagcaacttgaagaaggtatgaaagaaatattgcaagcaattaaggaaatgcagaaagatcctgatgttaaaggaggagaaacatctctaattatccctagccttgaaagactagttaatgctatagaatcaaagaatgcagaaggaatctttgatgcgagtctgcatttgaaagcccaagttgatcagcttaccggaagaaatgaagaattaagacaggagctcagggaatctcggaaagaggctataaattattcacagcagttggcaaaagctaatttaaagatagaccatcttgaaaaagaaactagtcttttacgacaatcagaaggatcaaatgttgtttttaaaggaattgacttacctgatgggatagcaccatctagtgccagtatcattaattctcagaatgaatatttaatacatttgttacaggaactagaaaataaagaaaaaaagttaaagaatttagaagattctcttgaagattacaacagaaaatttgctgtaattcgtcatcaacaaagtttgttgtataaagaatacctaagtgaaaaggagacctggaaaacagaatctaaaacaataaaagaggaaaagagaaaacttgaggatcaagtccaacaagatgctataaaagtaaaagaatataataatttgctcaatgctcttcagatggattcggatgaaatgaaaaaaatacttgcagaaaatagtaggaaaattactgttttgcaagtgaatgaaaaatcacttataaggcaatatacaaccttagtagaattggagcgacaacttagaaaagaaaatgagaagcaaaagaatgaattgttgtcaatggaggctgaagtttgtgaaaaaattgggtgtttgcaaagatttaaggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgagcttaccaaaatcaatttggatgcacagaaggtggaacagatgttaagagatgaattagctgatagtgtgagcaaggcagtaagtgatgctgataggcaacggattctagaattagagaagaatgaaatggaactaaaagttgaagtgtcaaaactgagagagatttctgatattgccagaagacaagttgaaattttgaatgcacaacaacaatctagggacaaggaagtagagtccctcagaatgcaactgctagactatcaggcacagtctgatgaaaagtcgctcattgccaagttgcaccaacataatgtctctcttcaactgagtgaggctactgctcttggtaagttggagtcaattacatctaaactgcagaagatggaggcctacaacttgcgcttagagcagaaacttgatgaaaaagaacaggctctctattatgctcgtttggagggaagaaacagagcaaaacatctgcgccaaacaattcagtctctacgacgacagtttagtggagctttacccttggcacaacaggaaaagttctccaaaacaatgattcaactacaaaatgacaaacttaagataatgcaagaaatgaaaaattctcaacaagaacatagaaatatggagaacaaaacattggagatggaattaaaattaaagggcctggaagagttaataagcactttaaaggataccaaaggagcccaaaaggtaatcaactggcatatgaaaatagaagaacttcgtcttcaagaacttaaactaaatcgggaattagtcaaggataaagaagaaataaaatatttgaataacataatttctgaatatgaacgtacaatcagcagtcttgaagaagaaattgtgcaacagaacaagtttcatgaagaaagacaaatggcctgggatcaaagagaagttgacctggaacgccaactagacatttttgaccgtcagcaaaatgaaatactaaatgcggcacaaaagtttgaagaagctacaggatcaatccctgaccctagtttgccccttccaaatcaacttgagatcgctctaaggaaaattaaggagaacattcgaataattctagaaacacgggcaacttgcaaatcactagaagagaaactaaaagagaaagaatctgctttaaggttagcagaacaaaatatactgtcaagagacaaagtaatcaatgaactgaggcttcgattgcctgccactgcagaaagagaaaagctcatagctgagctaggcagaaaagagatggaaccaaaatctcaccacacattgaaaattgctcatcaaaccattgcaaacatgcaagcaaggttaaatcaaaaagaagaagtattaaagaagtatcaacgtcttctagaaaaagccagagaggagcaaagagaaattgtgaagaaacatgaggaagaccttcatattcttcatcacagattagaactacaggctgatagttcactaaataaattcaaacaaacggcttgggatttaatgaaacagtctcccactccagttcctaccaacaagcattttattcgtctggctgagatggaacagacagtagcagaacaagatgactctctttcctcactcttggtcaaactaaagaaagtatcacaagatttggagagacaaagagaaatcactgaattaaaagtaaaagaatttgaaaatatcaaattacagcttcaagaaaaccatgaagatgaagtgaaaaaagtaaaagcggaagtagaggatttaaagtatcttctggaccagtcacaaaaggagtcacagtgtttaaaatctgaacttcaggctcaaaaagaagcaaattcaagagctccaacaactacaatgagaaatctagtagaacggctaaagagccaattagccttgaaggagaaacaacagaaagcacttagtcgggcacttttagaactccgggcagaaatgacagcagctgctgaagaacgtattatttctgcaacttctcaaaaagaggcccatctcaatgttcaacaaatcgttgatcgacatactagagagctaaagacacaagttgaagatttaaatgaaaatcttttaaaattgaaagaagcacttaaaacaagtaaaaacagagaaaactcactaactgataatttgaatgacttaaataatgaactgcaaaagaaacaaaaagcctataataaaatacttagagagaaagaggaaattgatcaagagaatgatgaactgaaaaggcaaattaaaagactaaccagtggattacagggcaaacccctgacagataataaacaaagtctaattgaagaactccaaaggaaagttaaaaaactagagaaccaattagagggaaaggtggaggaagtagacctaaaacctatgaaagaaaagaatgctaaagaagaattaattaggtgggaagaaggtaaaaagtggcaagccaaaatagaaggaattcgaaacaagttaaaagagaaagagggggaagtctttactttaacaaagcagttgaatactttgaaggatctttttgccaaagccgataaagagaaacttactttgcagaggaaactaaaaacaactggcatgactgttgatcaggttttgggaatacgagctttggagtcagaaaaagaattggaagaattaaaaaagagaaatcttgacttagaaaatgatatattgtatatgagggcccaccaagctcttcctcgagattctgttgtagaagatttacatttacaaaatagatacctccaagaaaaacttcatgctttagaaaaacagttttcaaaggatacatattctaagccttcaatttcaggaatagagtcagatgatcattgtcagagagaacaggagcttcagaaggaaaacttgaagttgtcatctgaaaatattgaactgaaatttcagcttgaacaagcaaataaagatttgccaagattaaagaatcaagtcagagatttgaaggaaatgtgtgaatttcttaagaaagaaaaagcagaagttcagcggaaacttggccatgttagagggtctggtagaagtggaaagacaatcccagaactggaaaaaaccattggtttaatgaaaaaagtagttgaaaaagtccagagagaaaatgaacagttgaaaaaagcatcaggaatattgactagtgaaaaaatggctaatattgagcaggaaaatgaaaaattgaaggctgaattagaaaaacttaaagctcatcttgggcatcagttgagcatgcactatgaatccaagaccaaaggcacagaaaaaattattgctgaaaatgaaaggcttcgtaaagaacttaaaaaagaaactgatgctgcagagaaattacggatagcaaagaataatttagagatattaaatgagaagatgacagttcaactagaagagactggtaagagattgcagtttgcagaaagcagaggtccacagcttgaaggtgctgacagtaagagctggaaatccattgtggttacaagaatgtatgaaaccaagttaaaagaattggaaactgatattgccaaaaaaaatcaaagcattactgaccttaaacagcttgtaaaagaagcaacagagagagaacaaaaagttaacaaatacaatgaagaccttgaacaacagattaagattcttaaacatgttcctgaaggtgctgagacagagcaaggccttaaacgggagcttcaagttcttagattagctaatcatcagctggataaagagaaagcagaattaatccatcagatagaagctaacaaggaccaaagtggagctgaaagcaccatacctgatgctgatcaactaaaggaaaaaataaaagatctagagacacagctcaaaatgtcagatctagaaaagcagcatttgaaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagttaaatatacttggaaataagcagttctccgaactgtagtatttccttctcactaccttgtacctttatacttagattggaattcttaataaataaaattatatgaaattttcaa

SEQ ID NO: 5436 - DNA, 3750 bp, Homo sapiens
aaggctggagccggcgagccccagcccagagaacaaaaggcctcgctagccggcgtcccgcgttgcccttggcaaccattgagcggcgtcttgcccttctgcgaccctgagatgagagagtaaacggggcccccattggccggccggggaagacgggccaatcggagaagagggtatagggaggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaaacctcttcatgctttccggaggtctaaaagtcttagctcagaaattcccggaaggactgattactggttccctgccagcatcttgccagcaggcccttcctcctgggtctgcccggaaacgatccagccccaaagggccacccctaccagctgagaataaatggagatttaccccagaagacttaaaaaagatagaatattatctggaagaggagcaagggcctgcagatcatcctagccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcagaacccctgagcatttcccaagttgggtcatttccagaaacttctgcagaggaaagaccatgacatatgtatgggataggcctcttccctgtccctgtctccagttcctctcccctcaggaggccacctcaggaaggattttgacaggtgaccataaaaaccagaggtgtgacaggctctagtctcctccctgttgtttacagcatatttaagtcttgtgaaactgtataggaaaaaagtatctacgtttttagtttttttgttttgtttttttttaataaggtccagcttgttgggtctctctgtgttgttttgtaaatacttcagtcacatctgcccgtgtgcctgtccctgccaccttttcattcactgttcttgacttcatgaaggcttctccgggcagtcttggtgtgagaagctgtttccaagggtgcagatgagccttaggttccagccgcctgcagaccccaccccagcaggctcactcagcaaggagctctctgcccagcatattgcaggccctgttttgagtatggaagccagtgcctgtgtactcactgaaattgaagatgaggaaagtagctgtacactcactgaatgctcccccttactagatatttcctggagccagaaaggtatgcatgtgggtgtcttcacaccggggaggagggcctctcatgggaaagccctggccaccacaccggcctgtgccccttgaagcccaccaaagcggccctcacttgtggtcagtatatcagttatgacgcccattgcccagcttcagtccatccatgttagatggacagaaattatggccagttgaaaataccagctttggttggacaactgtggacacacaaggtgaagaggactccgaagtcctttgtcagggctgacaacctcgtaagcccttgcttagaaatacagtattagtctaattgagtaattagtgcaatttcctgcttacttttcattctcatgactgaactgtgattaggaagttgtgattatagattctggttttggccggaattttgaatcagcattaattgaattgctaaatgactgacattcattccatttaattgggggaacaaaaggcctcaggtaaggatgaggaactctgaaatcagatggaaaagagcggtgttaatttttatggtctgtgatcgtagctgtgataagggactgaggaataaattgtgctctttgtcatggcaaccagcttctgaaaagcccactgaaaattgcctgtcctgctggtaactgctacggggtaagatttgccttaacagtactattttctcgccaccaaaaaaaaaaaaaaaaaaaaaaaaaaatgcaccacagtatttctagcatgggggctgtgtttgtatgagaaataaacgtaataaatatctcatagagacatatggaaaaataactttcagattcagcccagttctgttttagagtgtgtttattcttctctacttgatttccaaagtgcaacattttccgatgctttagaaatcaaacaaaccagggacattgttcagatgtcaagccatgcccaattttccacaagattcaagaatcttgtataaaattcagccaacgtacacatagctttaatgaggagcctgtcatgtttccccataaatttattgcctgagaacttagttcagcctttgctaatgccaaaatgctctggctttgtattttctttacagcatagatagaaaaatgcacatttttccacactcagctttcccctagcatggacaagattttcagccatttttgccacatatacatttttaaggaaaaaagatttttctctgtaagaaagttctggttatgctgttttaaaggtgacttgtcaggagttgagacttccctgccggattctattttgaaagtaaatggtcttccctccttgttccgattctgcgttcccatcgtcagacaactttggagtattagaaaccactgtatatatgtggaaagccaggtcagccagacctgttagaattggtgtgcactcacctgagagatctggcaggttggatatatttatgtgtatttctccacagtgcttgctttgccctgttggtaaggattttaaataaccatgctcaaaagagctgttctaatctgcgttttgcatgttaagtgttaatatcaaacattctttacgtgctcgaggtattgcttttaacattctactttgccagtttcttcattagattaattgacatgtattatttaaatgaccagtgatgctttgtgcaattatgaatgttgaagattaaagtacatagttactaa

SEQ ID NO: 5437 - DNA, 1087 bp, Homo sapiens
aaccccgaacgtggtcggttggagaaaatatgtccctccggaggcacattgggaaccctgagtatctgatgaaaaggataccacagaacccaagataccagcatatcaaatcaagactggacactggtaacagtatgactaaatatactgagaagctcgaagagattaagaaaaattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaaacctcttcatgctttccggaggccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcagaacccctgagcatttcccaagttgggtcatttccagaaacttctgcagaggaaagaccatgacatatgtatgggataggcctcttccctgtccctgtctccagttcc

SEQ ID NO: 5438 - DNA, 3161 bp, Homo sapiens
aggcggctgaacaaggttgtgggggtaggaagctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactggtgcctgtgtgtatcttaccagctccccagcactgccagactgtgccatgaatggattatgcttctgatgaaatccctggctgcgttttgttcagtcaccaccgcagggttcttgtatattctcaagcaccctctctgggtttctgttttgcagcactgcaggctgattaagggacactttccaaaccacagggctctccctttattagtccccacagtctttcattggctgcattgtcctcccatttctatctatattcaatctaatttccaatttctttagctttctgaaattctgtaggctttctccactcagtcttttctagccttatttttgtctttttaaaaattcaccttccttttattatctctagacaaactattcattccctcttttcttctttaggctttacttttcctgaatatttgctaatagccttgactgtaagcatcaaactcattatagactaggtactcttcatttttatttgttgtttaattctgtttcttccgtcaaaggaagaaatatatgtgaaaggcttttataaaccagaaagcactatacacacatatcacttattgaggttaacaaaggaccactgtgcctcttttcatgctttctgctcttccaagccaagagaacttctccatagaggagggaaatattgaagaaaaataaagccatggagttgtctcttagcaactgagttcgtgccttataaatctcatctactttagattactgctgcacaaaatcacttgcttttcttattggctcagtataaataatgttattaaattataggaaaacaatggaaaaaatctaatgaatgactcattcactgaatcagttgcactctgtgtttgcacagcactgttgctatagtcgggttgtttcttcctcttgattctaattgtaaagttttgttatatatcttttatcacaactttagttgtaagtaaacaaagtagaagctaaatgctaccttatacatttataggttgcttaagtcgtgaagcaatatgagtcatatatgtagcacataacatatactgtatataagtcaagttgtacatagtttaaagaaaatcaggtgtgcagaaactcagaccaaattgggaagtatttgcattataaaataactcattataaggatttttcagttagtagatctccatagtaaatttcattcagcaaatgtgtatttttcctatttatttatttatttatttattgagatgaagtctcgctctgttgcccaagctggagtgcagtggcgtgatcttggctcactgcaacctctgcctcccaggttcaagcgattcttctgcctcagcctcctgagtagctgggactacaggtgcgcaccaccatgcctggctaatttttatatttttagtagagacggggttttactatgttggtcaggctggtctcgaactcctgaccttgtgatcctcccgcctcggcctcccaaagtgctgggattacaggcgtgagccactgtgccaggtctagttatttatttatttattgtagagatgggctctcactgtgttggccagggtggtcttgaactcctggcctcgagcaatccttccacctcagtctcccaaagtgctgggattacaggtgtgagctatcacacctggccatttttttttttttttttttttttgagatagagtctcactctgtcacccgcattgtagtgcagtggcgcattcttgctcactgcaacctccccttcctgggctcaggggatcctcctacctcagcctctcaagtagctgggactacagggatgtgccaccatgcctggctagtttttgtgtatgtgtgtgttttgtagagacgaggtctcactattttgcccaggctggtccggaactcctgggctcaagcaatcctgcctcctcagcctcccaacgtgctgggattgcaggcatgatccagtgcacctgaccatcattcagcaagtatttttgagtgtctcctatgctagacaatggaagggataaagattattcatacgtgtgtgtgtgtgtgtgtgtgtacgtgcccataaatagtccttggctttctgtctagtaaggtaggtaagacaatacagtgataaatgccttgtgagttgtaagccgagtgctatagaggctcagaggagggaaaggtcacttcctgctgagtgagctcttacgagtatgtggcaaggtgatacgttagagaatgcaagactaagagtttgtcaagttaagtaattaaggcaacattaagaggtagtgagttggtgtccagtgctagagcaaggagtttcagctttagttaggaagcaatggggagccactgacttttttttttctttttgatcaaaaagtcttatctgggaaaatgtatctggcagtaatgtgtaatttcaattttttttaaaaaaaattggttcttggatagtcttttaggcttcttttgtatgaaacaaagccatgtttataaataagtgaattatgaaatggattcatttccaatctttttaaaaggtagtcagaaactatcttcagatgcaattagatacagtaagataggctgcatagttaagatgtaagcagtttacacagtgggataaaaatgctacttttcatactttctcaaaccatttttaggggtatttttgtgtcagccatcctgctatctcatttgtccaattaaagcaaggaagaaatcctccattctccttttttccccattcttggatagaatgaatgtctatagtgaaaagaactcatcagtagtcctctcagatttggtctgaatttcaccaaatatttgtataattgcaaaaaacttgtttctcagccttctcctttagggggaaaacaaatagagggcatgatggcctacctccctgcattgtggtgagggtcagctgatacaaaataaagtgttaagtgtaattaccctgaaatgtttgtaattaat

SEQ ID NO: 5439 - DNA, 1278 bp, Homo sapiens
agctagggttagaggcaacccgtgaggctagaaccccgaacgtggtcggttggagaaaatatgtccctccggaggcacattgggaaccctgagtatctgatgaaaaggataccacagaacccaagataccagcatatcaaatcaagactggacactgattatagatacaaaaaagatgagcttttcaagagactaaaagttacaacttttgcccagctgatcatccaagttgcttccctctctgatcaaacactggaagtgacagctgaggagattcaaaggctggaagacaatgattctgcagcttcagaccctgatgctgaaaccactgccaggaccaatgggaaaggaaatccaggtgagcagtcgccgagccctgagcagttcataaacaacgcaggagcaggggactccagccgctcaactcttcagagtgtcatcagtggtgttggggaactggatctagacaaagggccagtgaagaaagcagagccccataccaaagacaaaccttatcctgactgccccttcctgctgctagatgtgcgtgatagagattcttaccagcagtgccacattgttggagcttacagttacccaattgcaactctgtctagaacaatgaacccttattcaaatgatattcttgaatataaaaatgcccatggcaagatcatcattctgtatgacgatgatgaaaggctggccagtcaggcggccaccaccatgtgcgagcgtggatttgaaaacctcttcatgctttccggaggccgactgaaccaagctaactcctccggaagagagtccaaggtgcctggtgcccgaagcgctcagaatctgccaggtggcggccccgccagccactcaaacccccgctccctcagcagtggtcacctgcaaggcaaaccctggaagtaaagactttgtctcacttaggcaaataaatgttcttcctcttttcagaacccctgagcatttcccaagttgggtcatttccagaaacttctgcagaggaaagaccatgacatatgtatgggataggcctcttccctgtccctgtctccagttcctctcccctcaggaggccacctcaggaaggattttgacaggtgaccataaaaaccagaggtgtgacaggctctagtctcctccctgttgtttacagcatatttaagtcttgtgaaactgtataggaaaaaagtatctacgtttttagtttttttgttttgtttttttttaataaggtccagcttgttgggtctctctgtgttgttttgt

SEQ ID NO: 5440 - DNA, 1501 bp, Homo sapiens
cacacctgatggtgtgactcggccgacgcgagcgccgcgcttcgcttcagctgctagctggcccaagggaggcgaccgcggagggtggcgaggggcggccaggacccgcagccccggggccgggccggtccggaccgccagggagggcaggtcagtgggcagatcgcgtccgcgggattcaatctctgcccgctctgataacagtccttttccctggcgctcacttcgtgcctggcacccggctgggcgcctcaagaccgttgtctcttcgatcgcttctttggacttggcgaccatttcagagatgtcttccagaagtaccaaagatttaattaaaagtaagtggggatcgaagcctagtaactccaaatccgaaactacattagaaaaattaaagggagaaattgcacacttaaagacatcagtggatgaaatcacaagtgggaaaggaaagctgactgataaagagagacacagacttttggagaaaattcgagtccttgaggctgagaaggagaagaatgcttatcaactcacagagaaggacaaagaaatacagcgactgagagaccaactgaaggccagatatagtactaccacattgcttgaacagctggaagagacaacgagagaaggagaaaggagggagcaggtgttgaaagccttatctgaagagaaagacgtattgaaacaacagttgtctgctgcaacctcacgaattgctgaacttgaaagcaaaaccaatacactccgtttatcacagactgtggctccaaactgcttcaactcatcaataaataatattcatgaaatggaaatacagctgaaagatgctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtccagtttctttacacatctctgctaaagcagcaagaagaacaaacaagggtagctctgttggaacaacagatgcaggcatgtactttagactttgaaaatgaaaaactcgaccgtcaacatgtgcagcatcaattgcatgtaattcttaaggagctccgaaaagcaagaaataacacagttggaatccttgataccaaatca

SEQ ID NO: 5441 - DNA, 2638 bp, Homo sapiens
cacacctgatggtgtgactcggccgacgcgagcgccgcgcttcgcttcagctgctagctggcccaagggaggcgaccgcggagggtggcgaggggcggccaggacccgcagccccggggccgggccggtccggaccgccagggagggcaggtcagtgggcagatcgcgtccgcgggattcaatctctgcccgctctgataacagtccttttccctggcgctcacttcgtgcctggcacccggctgggcgcctcaagaccgttgtctcttcgatcgcttctttggacttggcgaccatttcagagatgtcttccagaagtaccaaagatttaattaaaagtaagtggggatcgaagcctagtaactccaaatccgaaactacattagaaaaattaaagggagaaattgcacacttaaagacatcagtggatgaaatcacaagtgggaaaggaaagctgactgataaagagagacacagacttttggagaaaattcgagtccttgaggctgagaaggagaagaatgcttatcaactcacagagaaggacaaagaaatacagcgactgagagaccaactgaaggccagatatagtactaccacattgcttgaacagctggaagagacaacgagagaaggagaaaggagggagcaggtgttgaaagccttatctgaagagaaagacgtattgaaacaacagttgtctgctgcaacctcacgaattgctgaacttgaaagcaaaaccaatacactccgtttatcacagactgtggctccaaactgcttcaactcatcaataaataatattcatgaaatggaaatacagctgaaagatgctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtccagtttctttacacatctctgctaaagcagcaagaagaacaaacaagggtagctctgttggaacaacagatgcaggcatgtactttagactttgaaaatgaaaaactcgaccgtcaacatgtgcagcatcaattgcatgtaattcttaaggagctccgaaaagcaagaaatcaaataacacagttggaatccttgaaacagcttcatgagtttgccatcacagagccattagtcactttccaaggagagactgaaaacagagaaaaagttgccgcctcaccaaaaagtcccactgctgcactcaatgaaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgctagtgaatcatgtatcttttaggctgctgtgcatttctcttggcagtgatacctccctgacatggttcatcatcaggctgcaatgacagaatgtggtgagcagcgtctactgagactactaacattttgcactgtcaaaatacttggtgaggaaaagatagctcaggttattgctaatgggttaatgcaccagcaagcaaaatattttatgttttgggggttttgaaaaatcaaagataattaaccaaggatcttaactgtgttcgcattttttatccaagcacttagaaaacctacaatcctaattttgatgtccattgttaagaggtggtgatagatactattttttttttcatattgtatagcggttattagaaaagttggggattttcttgatctttattgctgcttaccattgaaacttaacccagctgtgttccccaactctgttctgcgcacgaaacagtatctgtttgaggcataatcttaagtggccacacacaatgttttctcttatgttatctggcagtaactgtaacttgaattacattagcacattctgcttagctaaaattgttaaaataaactttaataaacccatgtagccctctcatttgattgacagtattttagttatttttggcattcttaaagctgggcaatgtaatgatcagatctttgtttgtctgaacaggtatttttatacatgctttttgtaaaccaaaaacttttaaatttcttcaggttttctaacatgcttaccactgggctactgtaaatgagaaaagaataaaattatttaatgttttaa

SEQ ID NO: 5442 - DNA, 747 bp, Homo sapiens
actcatcaataaataatattcatgaaatggaaatacagctgaaagatgctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtccagtttctttacacatctctgctaaagcagcaagaagaacaaacaagggtagctctgttggaacaacaggtactcattcgggttgcttctaaattcaattctgcctgttagaaaatgcagtttttcctcatgtttatgctgttctatggagaactgtttgaaagttgtgaaaagtgtctttaaaagacttcaataaaagtctttcttcttcaataaaaaagatatttcaaga

SEQ ID NO: 5443 - DNA, 3080 bp, Homo sapiens
gtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatataaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcattt

SEQ ID NO: 5444 - DNA, 3178 bp, Homo sapiens
gattggctaggaaagacgtccgttaggacgtgttgccctttctgtgtaagctgtgagcgtaggcggccctgagggggtgtgttgcaggggtttccaagcccagcaccagcacccttgcccttttccatcaggggttcagcctagggtccccgctggtgggcggctcccgagtcttggagaagagcacgagaacctagaccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatataaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatttgaa

SEQ ID NO: 5445 - DNA, 2084 bp, Homo sapiens
ccgcccccgaagtgcggagaccccctgggcaggctgaaagatggcggcggcgtctgtctctgcggcttctggttctcacttgtcgaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaaggtgtgaagacagaaccaaatcaggcaaaatgctgattacttggtatagtttatgtcaaaacacccataaactgtgtggtgtactacaaccttgagagagtaaatctttcattctcaatttcttcattcagaaggtggagataagtaatacctactcctaaatttttatcctgatagtgagaaaatatataagcattttggaactacagaacaccatacaaaattagcattattagtactgcattatcttgtgctcttacaatgttttgtgtatatgtatactgattttctacttagaatgtaactgttgttttgtcaagtgcttttttccccccagcctttcctaggctaggatatatgctaacaagtactattaggagctggcttgtgatcataatgccaactatagataaggcaagtagtagcctagtagttaactgaagtttcaagttagtcatgtatagtcagtttttattatcatgtgaataaaataaaattgttttccttttcttttcattcagaaaagttctaggaactattttggtgcacaaccacattatagattatgcttgggtgatatgccatttgtagctgggaaggtgagttggtcaaactccggattctttttatacaacattgatccctgaattaagtccctgcatctgcaagtatgtctacaaatggaaggaacatttttctgtgcctttaccagtgtgtggatcacagtgatgtgaaaatgagatgtagggaggtttttggggattagggaagcaaggaagagatggggaggataccttaaagtagataaagtatatgtggaaaggaagtgataaaacagagaccctaagttgaagaaggtgttgtttcagataggggtcaaggaaataagaaatagtatgtttgtagcattggatttttagtatcaatcctgttgagttacatttagatataggtagatattcgaataagcacgtagcacattctgcttgtcctcacatccagatcatttctaggactaattctccaagaagcagtcatacgtacacttgaatcttcagtttcttcagcacttgaatgtaaagctgtattgtcatatatcaagtactgagtgaagtgcctaaaactgtgctagttgacactactttataagctgtttgtgttgctggtggttttatatttagattccaactagattgttattctggcatcttgggaagtaaatgttcttctgaattttg

SEQ ID NO: 5446 - DNA, 2910 bp, Homo sapiens
atgttgaccagaattgataacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaagaactgacatctcagttgttagctgcagaaaataaatgcaatctattagaaaaacaattggaatacatgcgaaatatgataaagcatgccgaaatggagaggacatctgtcttagagaaacaagtttccctagaaagagaacgacaacatgatcaaacacatgttcagagccaacttgaaaaattggatcttcttgaacaggagtataacaaacttaccacaatgcaggcccttgcagaaaaaaaaatgcaagagttggaagcaaaactccatgaagaagaacaggaaaggaaacgcatgcaagctaaggcagctgagttgcagactggtctagaaacaaatagacttatctttgaagataaggcaactccgtgtgttcccaatgcaagaagaattaaaaaaaagaagtcaaaaccaccagaaaagaaaagttctaggaactattttggtgcacaaccacattatagattatgcttgggtgatatgccatttgtagctgggaagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagctttgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatataaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcattt

SEQ ID NO: 5447 - DNA, 2732 bp, Homo sapiens
attcgcaggccaaagaggggctggccctcgacgcgctcgggctcgattggccgccctcccccggcggtggtaacggtcgcggaggcggggcctgacgtagctgatcccagcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgtttctcacttccaaaagttatttgatgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaaattgatgacttggatgccattgtacctgcagtaaagaaattaaaagtactttcatactgaaaacaaatcaaatcatttttactgtgtaaattgtattcttaacattttgtattttgtaggattgatcttattttgagacaagggttgtaaaatgtatttgctctcagaattcatccccttcttagtattaggtcattcttcatctgtataatttttattaactttgagattcttatacagaaaatagttgcaagggtaaggtaattaactttagatcccttcatttctaaagcaattattgagtgcttaaaatttaaggttgttttagagtggagtttgtgagtaaaagaggagcccagggagacagattgcaagtagtaggttgcaatcttttagattcagcttgtaataatctttgagccacaccaaaaggaatgccaagggctctctaaatttagccagtaggaagctactgctctcctggcaaggattaattggcacattctgttaagatatccctcatgacagttgccctttcaaagcaggaggaagaaaaggaagaaagaaaaactgtttcatcatttctgttagggtaggaaatgaatcatagggtaaaatggatgagtagatagaagtctctcatttaaaaagtgtcttttgcaatcttgatgtaatgcactttttataaggacttgagatctcaaataaaatttctgtaaagaatttccaaa

SEQ ID NO: 5448 - DNA, 1054 bp, Homo sapiens
atgaagatccagtttcagacatgagactcgttgggtgatcatttcattgagatcaacctgaatgaccaggtgtaaagtgcaagagtaatatgctatgactgaggcaactcaaattttttaattgccaatttctgtttcttttgattctacaaaagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagtaattttgctacataaattgatatgtagctagattcattgttgtgtttgtttgtttgttttacctgatattatcttgggggtggttataactcttataaactagaaaagcctctctctcctcctcttctgcattgtttttccctgctcatcctgttcttttttttttttttttttgttctagaggtcctttgaagaatggaattgaacatttactaaaaataacactaaacttttaaataaattcataattaatcaga

SEQ ID NO: 5449 - DNA, 551 bp, Homo sapiens
ataagcctccatgtaagtgacagggcacccaaggagtgcgttggaagcgccagcgtgcccgagaccagcacatcgcaccgacgccttcgtttgcgatgaagatccagtttcagacatgagactcgttgggtgatcatttcattgagatcaacctgaatgaccaggtgtaaagtgcaagagtaatatgctatgactgagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaa

SEQ ID NO: 5450 - DNA, 2037 bp, Homo sapiens
agcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgtttctcacttccaaaagttatttgatgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagaggtatttgttttaaaagtttacaaagtatcatccagaatggctgggtgtggtggcacacgcctgtagtcccagctacttgggaggctgatgtgggaggatcacttgaacccaggagtttaagtccagtctgagcaaggcagtgagaccctgtctctaaacaataaaaattaaaataagtattatcgagagttcctggaggggtgaaattaaagactttcaaaactta

SEQ ID NO: 5451 - DNA, 1993 bp, Homo sapiens
ctggtgggaggccggcgactgagtaagatgaagatccagtttcagacatgagactcgttgggtgatcatttcattgagatcaacctgaatgaccaggtgtaaagtgcaagagtaatatgctatgactgaggcaactcaaattttttaattgccaatttctgtttcttttgattctacaaaagtaactatgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgtttctcacttccaaaagttatttgatgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaaattgatgacttggatgccattgtacctgcagtaaagaaattaaaagtactttcatactgaaaacaaatcaaa

SEQ ID NO: 5452 - DNA, 598 bp, Homo sapiens
tcacctgggcctaaaagtggtcagactgacccttgtcggggaggagccatctgggacagggtcgcgccaattaaaaatccctgcgtaagggtttggggatcggacaaaactgcctccagtcccagctccccaggctttgtgttctttggcttctcctttaatgtctcagcgcctccgattctttatttgtatactaaagctggtaattcttgccttacaaggtggttgtgagggttaaatgaggcagtaagagtaaagcttagaatcacgtcgggcacagactcgatttaagctgtaggtaattactccatcccccaaaatcgacccgggctgaagcgctagttttgtgtcaaacaaccgcgaaggttgtttggggagtgaggactcggagcagaagggggcggttaggcgaatagcacagatgaagatccagtttcagacatgagactcgttgggtgatcatttcattgagatcaacctgaatgaccaggtgtaaagtgcaagagtaatatgctatgactgagtaactatgtttccggtagcccctaaaccccaggattccagtcaaccatcagacagactcatgactgaaaaacag

SEQ ID NO: 5453 - DNA, 2359 bp, Homo sapiens
agcctaacctggcccggctggctgctggtgggaggccggcgactgagtaagatgaagatccagtttcagacatgagactcgttgggtgatcatttcattgagatcaacctgaatgaccaggtgtaaagtgcaagagtaatatgctatgactgagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagttgctttgtctaattgattactatgaatctaaaattagaaaaattcatacacaaaggcaatataaagaagatgaaagtcagtcagaagaagaaaacgactacagaaatctggatgcctcaccaacttataaaggccttttaatgtcattacagaatcaactcaaggaatcaaaatctaagattgatgcactttcaagtgaaaagctgaacctccaaaaagatttggaaaccaggcctacgcagcatgaattaagactttataaacagcaggtgaagaagctggaaaaagcccttaagaaaaacgtcaaattacaggagcttattaatcataagaaggctgaggacacagagaagaaagatgagcccagcaaatataatcagcaacaggccctaattgaccagagatactttcaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgtttctcacttccaaaagttatttgatgtgccttctttaaatggagtctatccccgaatgaatgaagtttatactaggcttggagaaatgaacaatgctgtgagaaacctccaagaactcttagaattagatagttcatcctcattgtgtgtgctagtaagcactgttggaaaactctgtaggctgattaatgaagatgtgaatgagcaggttatgcaggtattaggacctgaagacctccagagcattatctacaaattggaagaacacgaggaatttttcccagcatttcaggcatttactaatgatctacttgaaatcttagaaattgatgacttggatgccattgtacctgcagtaaagaaattaaaagtactttcatactgaaaacaaatcaaatcatttttactgtgtaaattgtattcttaacattttgtattttgtaggattgatcttattttgagacaagggttgtaaaatgtatttgctctcagaattcatccccttcttagtattaggtcattcttcatctgtataatttttattaactttgagattcttatacagaaaatagttgcaagggtaaggtaattaactttagatcccttcatttctaaagcaattattgagtgcttaaaatttaaggttgttttagagtggagtttgtgagtaaaagaggagcccagggagacagattgcaagtagtaggttgcaatcttttagattcagcttgtaataatctttgagccacaccaaaaggaatgccaagggctctctaaatttagccagtaggaagctactgctctcctggcaaggattaattggcacattctgttaagatatccctcatgacagttgccctttcaa

SEQ ID NO: 5454 - DNA, 4367 bp, Homo sapiens
gaggggcggagccccggcccggaggtctgtcatgctgttcccgctccaggtggccgctgtaacctcttcggtccgcgacgatcctctagagcactgtgtgtctccccggacgcgagcccgctcccctgaaatctgcaaaatggctgataatttggatgaatttattgaagagcaaaaagccagattggccgaagacaaagcagagttggaaagtgatccaccttacatggaaatgaagggaaagttgtcagcgaagctttctgaaaacagtaagatactgatctctatggctaaggaaaacataccaccaaatagtcaacagaccaggggttccttaggaattgattatggattaagtttaccacttggagaagactatgaacggaagaaacataaattaaaagaagaattgcggcaagattacagacgttatcttactcaggaaaggttgaaacttgaacgtaacaaagaatacaatcagtttctcaggggtaaggaagaatccagtgaaaagttcaggcaggtggaaaagagtactgagcccaagagtcagagaaataaaaaacctattggtcaagttaagcctgatctaacttcacaaatacagacatcttgtgaaaattcagagggtcctagaaaagatgtcttaactccttcagaggcatatgaagaacttctgaaccaaagacgactagaggaggacagataccgacaactagatgatgaaatcgaattaaggaatagaagaattattaaaaaagcaaatgaagaagtgggcatttccaacctaaaacatcaaaggtttgcaagcaaggctggcattccagatagaagatttcacagatttaatgaggatcgtgtttttgatagacggtatcatagaccagaccaagatcctgaagtaagtgaagaaatggatgagaggtttagatatgaaagtgattttgatagaagactttcgagagtgtatacaaatgacaggatgcacaggaacaaacgagggaatatgcctcctatggaacatgatggggatgttatagaacagtcaaacataagaatttcatctgctgaaaataaaagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacgagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataactgatttgaataggatgcacagacaaaatatagatgcctaccataacccagatgcaagaacatatgaagataaaagggctgttgtatctctagacccaaatttagccacttcaaatgctgagaacctagaagatgctgcaaataaaagctcaggtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcagaaagaaagaagaaagaagaagaagaaaaatataacctgcaacttcagcactactgtgaaagagacaatttgattggggaagaaacaaagcacatgagacagccttctcctatagttcctgctcttcagaacaaaattgcaagcaaactccaaagacctccttcagttgacagcatcatacgttcctttattcatgaaagttccatgtccagggcacagtcacccccggtacctgccaggaaaaatcagctccgtgcagaagaggagaaaaaaaatgtaattatggaattatcagaaatgagaaaacagcttcgtagtgaagagaggcgtctacaagagcgattgctacacatggacagtgatgatgaaattcctatcaggaaaaaggaaaggaatcccatggatatatttgatatggctagacatcggttgcaagctcctgtcagaagacagtcccctaagggcttagacgctgccacttttcagaatgttcatgattttaatgagctgaaagatagagattcagaaacacgagttgatctgaaatttatgtacctggatcctccaagagatcatcacaccttagagattcagcagcaagccctgctaagagagcagcagaagaggctgaacagaataaaaatgcaggaaggtgccaaagttgacttagatgccatcccaagtgctaaagtacgagagcaaagaatgcccagagatgacactagtgatttcttgaaaaactcattattggaatctgatagtgcttttattggggcttacggtgagacatatcctgccattgaagatgacgtcctccctccaccatcacagttgccctctgcacgggagcgcaggaggaacaaatggaaaggactagacattgatagcagtcgtcctaatgtagcaccagatggtctctctctaaaatctatatccagtgtaaatgttgatgagcttagagtgagaaatgaggaacgaatgcgaagactgaatgaatttcacaataaacctattaatacagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcacttggcagggcctgtcgactgcacatggttaaaataaacctgtactggacccagtagtgccttttaaggtgaaaggaatggtaaatctgtacctttaatatgtcctacttttggcccctacctgaaagttactttttttccatcatctgtatataaaattatttttatcatgatgtatattatgtacataaataaaaggccatgattattgatttatataatagaattgtatagattatttttgcacagttttgtcataaattagggtggtaatgaactggattgaactactatatgtgcattatattgaattctgcttgtcattaagataaggtgaataagtgtcttaaacgtcctgtaaaaccggactcccctttgttacatgcacattttccattgttacctcgatgcaaaagaattcatttagtaggtacatctattgtagctgtgattattccagtttctgtgtgatgcaatcaaatgtcctattaattaattattatttcatgtcatttgtagctactgatacagcagaaatgaagggaactgtaattacttgtatttttgtaagccatacgttaaatgtttgttacatcatctttctgcttctatttttatgccaatgaaggcatttgtcttgttactaattacatgatgtaactacttcttgatataaataaatttttattttaattactaaaa

SEQ ID NO: 5455 - DNA, 4468 bp, Homo sapiens
gaggggcggagccccggcccggaggtctgtcatgctgttcccgctccaggtggccgctgtaacctcttcggtccgcgacgatcctctagagcactgtgtgtctccccggacgcgagcccgctcccctgaaatctgcaaaatggctgataatttggatgaatttattgaagagcaaaaagccagattggccgaagacaaagcagagttggaaagtgatccaccttacatggaaatgaagggaaagttgtcagcgaagctttctgaaaacagtaagatactgatctctatggctaaggaaaacataccaccaaatagtcaacagaccaggggttccttaggaattgattatggattaagtttaccacttggagaagactatgaacggaagaaacataaattaaaagaagaattgcggcaagattacagacgttatcttactcagaaggttttcagtggtactagcaaaaaaaattttctatctacgagtgaaacagatccatctactttgggagtttctcttcctattggtgagaggttatctgctaaggaaaggttgaaacttgaacgtaacaaagaatacaatcagtttctcaggggtaaggaagaatccagtgaaaagttcaggcaggtggaaaagagtactgagcccaagagtcagagaaataaaaaacctattggtcaagttaagcctgatctaacttcacaaatacagacatcttgtgaaaattcagagggtcctagaaaagatgtcttaactccttcagaggcatatgaagaacttctgaaccaaagacgactagaggaggacagataccgacaactagatgatgaaatcgaattaaggaatagaagaattattaaaaaagcaaatgaagaagtgggcatttccaacctaaaacatcaaaggtttgcaagcaaggctggcattccagatagaagatttcacagatttaatgaggatcgtgtttttgatagacggtatcatagaccagaccaagatcctgaagtaagtgaagaaatggatgagaggtttagatatgaaagtgattttgatagaagactttcgagagtgtatacaaatgacaggatgcacaggaacaaacgagggaatatgcctcctatggaacatgatggggatgttatagaacagtcaaacataagaatttcatctgctgaaaataaaagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacgagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataactgatttgaataggatgcacagacaaaatatagatgcctaccataacccagatgcaagaacatatgaagataaaagggctgttgtatctctagacccaaatttagccacttcaaatgctgagaacctagaagatgctgcaaataaaagctcaggtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcagaaagaaagaagaaagaagaagaagaaaaatataacctgcaacttcagcactactgtgaaagagacaatttgattggggaagaaacaaagcacatgagacagccttctcctatagttcctgctcttcagaacaaaattgcaagcaaactccaaagacctccttcagttgacagcatcatacgttcctttattcatgaaagttccatgtccagggcacagtcacccccggtacctgccaggaaaaatcagctccgtgcagaagaggagaaaaaaaatgtaattatggaattatcagaaatgagaaaacagcttcgtagtgaagagaggcgtctacaagagcgattgctacacatggacagtgatgatgaaattcctatcaggaaaaaggaaaggaatcccatggatatatttgatatggctagacatcggttgcaagctcctgtcagaagacagtcccctaagggcttagacgctgccacttttcagaatgttcatgattttaatgagctgaaagatagagattcagaaacacgagttgatctgaaatttatgtacctggatcctccaagagatcatcacaccttagagattcagcagcaagccctgctaagagagcagcagaagaggctgaacagaataaaaatgcaggaaggtgccaaagttgacttagatgccatcccaagtgctaaagtacgagagcaaagaatgcccagagatgacactagtgatttcttgaaaaactcattattggaatctgatagtgcttttattggggcttacggtgagacatatcctgccattgaagatgacgtcctccctccaccatcacagttgccctctgcacgggagcgcaggaggaacaaatggaaaggactagacattgatagcagtcgtcctaatgtagcaccagatggtctctctctaaaatctatatccagtgtaaatgttgatgagcttagagtgagaaatgaggaacgaatgcgaagactgaatgaatttcacaataaacctattaatacagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcacttggcagggcctgtcgactgcacatggttaaaataaacctgtactggacccagtagtgccttttaaggtgaaaggaatggtaaatctgtacctttaatatgtcctacttttggcccctacctgaaagttactttttttccatcatctgtatataaaattatttttatcatgatgtatattatgtacataaataaaaggccatgattattgatttatataatagaattgtatagattatttttgcacagttttgtcataaattagggtggtaatgaactggattgaactactatatgtgcattatattgaattctgcttgtcattaagataaggtgaataagtgtcttaaacgtcctgtaaaaccggactcccctttgttacatgcacattttccattgttacctcgatgcaaaagaattcatttagtaggtacatctattgtagctgtgattattccagtttctgtgtgatgcaatcaaatgtcctattaattaattattatttcatgtcatttgtagctactgatacagcagaaatgaagggaactgtaattacttgtatttttgtaagccatacgttaaatgtttgttacatcatctttctgcttctatttttatgccaatgaaggcatttgtcttgttactaattacatgatgtaactacttcttgatataaataaatttttattttaattact

SEQ ID NO: 5456 - DNA, 4315 bp, Homo sapiens
gaggggcggagccccggcccggaggtctgtcatgctgttcccgctccaggtggccgctgtaacctcttcggtccgcgacgatcctctagagcactgtgtgtctccccggacgcgagcccgctcccctgaaatctgcaaaatggctgataatttggatgaatttattgaagagcaaaaagccagattggccgaagacaaagcagagttggaaagtgatccaccttacatggaaatgaagggaaagttgtcagcgaagctttctgaaaacagtaagatactgatctctatggctaaggaaaacataccaccaaatagtcaacagaccaggggttccttaggaattgattatggattaagtttaccacttggagaagactatgaacggaagaaacataaattaaaagaagaattgcggcaagattacagacgttatcttactcagggcattacacaagggaaaagaaagaaaaattttctatctacgagtgaaacagatccatctactttgggagtttctcttcctattggtgagaggttatctgctaaggaaaggttgaaacttgaacgtaacaaagaatacaatcagtttctcaggggtaaggaagaatccagtgaaaagttcaggcaggtggaaaagagtactgagcccaagagtcagagaaataaaaaacctattggtcaagttaagcctgatctaacttcacaaatacagacatcttgtgaaaattcagagggtcctagaaaagatgtcttaactccttcagaggcatatgaagaacttctgaaccaaagacgactagaggaggacagataccgacaactagatgatgaaatcgaattaaggaatagaagaattattaaaaaagcaaatgaagaagtgggcatttccaacctaaaacatcaaaggtttgcaagcaaggctggcattccagatagaagatttcacagatttaatgaggatcgtgtttttgatagacggtatcatagaccagaccaagatcctgaagtaagtgaagaaatggatgagaggtttagatatgaaagtgattttgatagaagactttcgagagtgtatacaaatgacaggatgcacaggaacaaacgagggaatatgcctcctatggaacatgatggggatgttatagaacagtcaaacataagaatttcatctgctgaaaataaaagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacgagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataagtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcagaaagaaagaagaaagaagaagaagaaaaatataacctgcaacttcagcactactgtgaaagagacaatttgattggggaagaaacaaagcacatgagacagccttctcctatagttcctgctcttcagaacaaaattgcaagcaaactccaaagacctccttcagttgacagcatcatacgttcctttattcatgaaagttccatgtccagggcacagtcacccccggtacctgccaggaaaaatcagctccgtgcagaagaggagaaaaaaaatgtaattatggaattatcagaaatgagaaaacagcttcgtagtgaagagaggcgtctacaagagcgattgctacacatggacagtgatgatgaaattcctatcaggaaaaaggaaaggaatcccatggatatatttgatatggctagacatcggttgcaagctcctgtcagaagacagtcccctaagggcttagacgctgccacttttcagaatgttcatgattttaatgagctgaaagatagagattcagaaacacgagttgatctgaaatttatgtacctggatcctccaagagatcatcacaccttagagattcagcagcaagccctgctaagagagcagcagaagaggctgaacagaataaaaatgcaggaaggtgccaaagttgacttagatgccatcccaagtgctaaagtacgagagcaaagaatgcccagagatgacactagtgatttcttgaaaaactcattattggaatctgatagtgcttttattggggcttacggtgagacatatcctgccattgaagatgacgtcctccctccaccatcacagttgccctctgcacgggagcgcaggaggaacaaatggaaaggactagacattgatagcagtcgtcctaatgtagcaccagatggtctctctctaaaatctatatccagtgtaaatgttgatgagcttagagtgagaaatgaggaacgaatgcgaagactgaatgaatttcacaataaacctattaatacagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcacttggcagggcctgtcgactgcacatggttaaaataaacctgtactggacccagtagtgccttttaaggtgaaaggaatggtaaatctgtacctttaatatgtcctacttttggcccctacctgaaagttactttttttccatcatctgtatataaaattatttttatcatgatgtatattatgtacataaataaaaggccatgattattgatttatataatagaattgtatagattatttttgcacagttttgtcataaattagggtggtaatgaactggattgaactactatatgtgcattatattgaattctgcttgtcattaagataaggtgaataagtgtcttaaacgtcctgtaaaaccggactcccctttgttacatgcacattttccattgttacctcgatgcaaaagaattcatttagtaggtacatctattgtagctgtgattattccagtttctgtgtgatgcaatcaaatgtcctattaattaattattatttcatgtcatttgtagctactgatacagcagaaatgaagggaactgtaattacttgtatttttgtaagccatacgttaaatgtttgttacatcatctttctgcttctatttttatgccaatgaaggcatttgtcttgttactaattacatgatgtaactacttcttgatataaataaatttttattttaattact

SEQ ID NO: 5457 - DNA, 3715 bp, Homo sapiens
cagtcagaccgctaacaggagaaatggaatattaagtatagtatattgttccccctcaccttttctcatttcttcctctgtctcaggcactcattcatatattcatttgcagatttattcaatgaacattttcttgggttaaagttatgtgccagcattataaaattgaatagcgcatgggccttgccttcatagattttatagtttagttttatatatgatgttccattctgaacatgagaatcaaaactttctctccttaggcttaaattctgtatctttaaaaaaaggtttagattccttcaaaaggaaacagttcctttctaggatgatttaaaattccaagcatatggaatgctttagtttcttttggaagagagttagaagcatgtgtaagaggtgtccctaaggaatcctctgttataccctctatcatcaaggagttaaataggccagaaatgtttatcaagagaattccagtgttgatagcggaattgattatggattaagtttaccacttggagaagactatgaacggaagaaacataaattaaaagaagaattgcggcaagattacagacgttatcttactcaggaaaggttgaaacttgaacgtaacaaagaatacaatcagtttctcaggggtaaggaagaatccagtgaaaagttcaggcaggtggaaaagagtactgagcccaagagtcagagaaataaaaaacctattggtcaagttaagcctgatctaacttcacaaatacagacatcttgtgaaaattcagagggtcctagaaaagatgtcttaactccttcagaggcatatgaagaacttctgaaccaaagacgactagaggaggacagataccgacaactagatgatgaaatcgaattaaggaatagaagaattattaaaaaagcaaatgaagaagtgggcatttccaacctaaaacatcaaaggtttgcaagcaaggctggcattccagatagaagatttcacagatttaatgaggatcgtgtttttgatagacggtatcatagaccagaccaagatcctgaagtaagtgaagaaatggatgagaggtttagatatgaaagtgattttgatagaagactttcgagagtgtatacaaatgacaggatgcacaggaacaaacgagggaatatgcctcctatggaacatgatggggatgttatagaacagtcaaacataagaatttcatctgctgaaaataaaagtgctccagacaatgaaacatccaaatctgctaatcaagatacctgtagtccttttgcagggatgctctttggaggtgaagatcgagaacttattcagagaaggaaagagaaatacagactagaactgttggaacaaatggctgagcaacagaggaacaagagacgagaaaaagatttagaactcagggttgcagcgtctggagcacaagaccctgagaaatcgcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggattgcacctctgcctccacctcccctactaccacctttggctactaactatcgaactccttatgatgatgcatactatttttatgggtccaggaatactttcgatcccagtcttgcttattatggttcaggaatgatgggcgtacagcctgcagcttatgttagtgctcctgtcacccaccaactagcacaacctgttgtgaatacggttggacagaatgaactgaagattacaagtgatcaagtgataaattcaggattgatttttgaagataaaccgaaaccttccaaacagtcacttcagtcttaccaagaggctttgcagcagcagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataagtcatatgcaaacacagagctctccttttgctcggggaaatgtatttggtgagcctccaactgaacttcagattaaacagcaagaattatacaagaattttcttcgtttccagattgaggaaaagaaacaaagagaggaagcagagcgagagagactgagaattgcagaagaaaaagaagaaagacggcttgcagaacagagggcacgaattcagcaggagtatgaagaggaacaggaaaagaaaagagagaaagaggaggagcaaaggctaaaaaatgaagagcatattcggttagctgaagaaagacaaaaagaagcagaaagaaagaagaaagaagaagaagaaaaatataacctgcaacttcagcactactgtgaaagagacaatttgattggggaagaaacaaagcacatgagacagccttctcctatagttcctgctcttcagaacaaaattgcaagcaaactccaaagacctccttcagttgacagcatcatacgttcctttattcatgaaagttccatgtccagggcacagtcacccccggtacctgccaggaaaaatcagctccgtgcagaagaggagaaaaaaaatgtaattatggaattatcagaaatgagaaaacagcttcgtagtgaagagaggcgtctacaagagcgattgctacacatggacagtgatgatgaaattcctatcaggaaaaaggaaaggaatcccatggatatatttgatatggctagacatcggttgcaagctcctgtcagaagacagtcccctaagggcttagacgctgccacttttcagaatgttcatgattttaatgagctgaaagatagagattcagaaacacgagttgatctgaaatttatgtacctggatcctccaagagatcatcacaccttagagattcagcagcaagccctgctaagagagcagcagaagaggctgaacagaataaaaatgcaggaaggtgccaaagttgacttagatgccatcccaagtgctaaagtacgagagcaaagaatgcccagagatgacactagtgatttcttgaaaaactcattattggaatctgatagtgcttttattggggcttacggtgagacatatcctgccattgaagatgacgtcctccctccaccatcacagttgccctctgcacgggagcgcaggaggaacaaatggaaaggactagacattgatagcagtcgtcctaatgtagcaccagatggtctctctctaaaatctatatccagtgtaaatgttgatgagcttagagtgagaaatgaggaacgaatgcgaagactgaatgaatttcacaataaacctattaatacagatgatgagagttcactggttgaccctgatgacatcatgaaacacataggggatgacggatcaaactctgtagcaactgagccctggctccgccctggcacttcagaaacgctgaaacgtttcatggcagagcagctgaaccaggagcagcagcagattcctggaaaaccaggcactttcacttggcagggcctgtcgactgcacatggttaaaataaacctgtactggac

SEQ ID NO: 5458 - DNA, 1677 bp, Homo sapiens
atgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaataatggaatatgaagggcacgctctgtcactgcttaaggaatgtgaactccagggatttgatggtgggcatcggaaaccattgttcgcaatacattggagtgtacagagattgttcactggcatgcaaacgttagaaccaagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaa

SEQ ID NO: 5459 - DNA, 1330 bp, Homo sapiens
atgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaacatgtaattgtttctaaaagaaatgtacaaactagaattttaatataaagaaatgtggccatgctttaaa

SEQ ID NO: 5460 - DNA, 1392 bp, Homo sapiens
atgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaagatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaa

SEQ ID NO: 5461 - DNA, 3208 bp, Homo sapiens
gcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcaggctttccaaacagaccgaagtcattaaaaatactccttaacccccaaagtcacaaaaaagaagctacccaggtttattatgagaaggttgaacctctgttgaagcttgcaggaataaaaactgatgtaacaataatggaatatgaagggcacgctctgtcactgcttaaggaatgtgaactccagggatttgatggtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcagataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaaggcagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttcatg

SEQ ID NO: 5462 - DNA, 2425 bp, Homo sapiens
gcagcgctggacgcggctagagctggggctgccgcgccctccacctccttctccaaaggcctccccggacccctggctcgggcccagcctgcgactccgccatgccctggaggaggcgcaggaaccgggtgagtgccctggagggcggccgggaggaagaggcgcccccggaggctgccgctgtgcctccggcgctgttaacgtccccgcagcagacggaggcggcggccgagcggattctgctccggggcatcttcgagatcgggagggacagttgtgacgtggtgctgagcgagcgagcactgcggtggcggcccattcagcccgagcgcccggcgggtgattctaagtatgacttgctatgtaaagaagaatttattgaactcaaagacatattctctgtgaaactgaaacggcgttgttctgttaaacagcagagaagtggtactttattaggtatcacactcttcatctgcttgaaaaaggaacaaaataaactaaagaattctacacttgatcttattaatttaagtgaagaccactgtgacatatggtttagacagttcaagaaaatattggcagtaatggaatatgaagggcacgctctgtcactgcttaaggaatgtgaactccagggatttgatggtgggcatcggaaaccattgttcgcaatacattggagtgtacagagattgttcactggcatgcaaacgttagaaccaagtgttgtctgtgttggtggagatggatctgctagcgaagtagcccatgctttgcttctgagagctcagaagaatgctgggatggaaacagaccgaatcctgactcctgtcagagcacagcttccacttggcttaataccagcaggatctaccaatgtattggcacattctcttcatggagttcctcatgtgataactgcaacattgcacattataatggggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctgactgtaatgatcaatggcaaatgatccagggtcagttcttgaatgtcagcattatggcaattccttgcctgtgttcagtggcacctagaggcttggcacctaataccagattaaataatggaagtatggctcttataattgcccgaaacacttctcggccagaatttataaaacacctgaaaagatatgccagtgtaaaaaatcagttcaattttccatttgttgagacttacactgttgaggaagtaaaagttcatccaaggaataatactggtggatataatccagaggaggaggaggatgaaactgcttcagaaaattgtttcccttggaatgtagatggtgacttaatggaagttgcatcagaggtccatattagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttccgtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttagatatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactat

SEQ ID NO: 5463 - DNA, 1215 bp, Homo sapiens
ctttgggcctcatcatttacaaaagaagcttgggcccctgacagcatgcatctcctcttatttcagctgctggtactcctgcctctaggaaagaccacacggcaccaggatggccgccagaatcagagttctctttcccccgtactcctgccaaggaatcaaagagagcttcccacaggcaaccatgaggaagctgaggagaagccagatctgtttgtcgcagtgccacaccttgtagccaccagccctgcaggggaaggccagaggcagagagagaagatgctgtccagatttggcaggttctggaagaagcctgagagagaaatgcatccatccagggactcagatagtgagcccttcccacctgggacccagtccctcatccagccgatagatggaatgaaaatggagaaatctcctcttcgggaagaagccaagaaattctggcaccacttcatgttcagaaaaactccggcttctcagggggtcatcttgcccatcaaaagccatgaagtacattgggagacctgcaggacagtgcccttcagccagactataacccacgaaggctgtgaaaaagtagttgttcagaacaacctttgctttgggaaatgcgggtctgttcattttcctggagccgcgcagcactcccatacctcctgctctcactgtttgcctgccaagttcaccacgatgcacttgccactgaactgcactgaactttcctccgtgatcaaggtggtgatgctggtggaggagtgccagtgcaaggtgaagacggagcatgaagatggacacatcctacatgctggctcccaggattcctttatcccaggagtttcagcttgaagagctatcccactattacctttgaaaagcaaaaccacaacagcaaagatgctgattattcagtctgaaaatgttaagtgggtacataacattttcagggaaaggtgacttgaaacgtagttttaaattagaacgatagaggaaatgatattagtctagttattggtacacgtttgagaccttgtctcagctctgccactaactagccgtagaatgttaagttgtaaaacctttctccatctaaagattttcatctataaatgacggacccgacctagatgattgctaaaatcctttccactactaatattccgtgatgcattttctccaagtttgggtaaaagccctccatctaaagaaggaaaa

SEQ ID NO: 5464 - DNA, 1299 bp, Homo sapiens
ttgttggaagacatgaagatgctggaagacacagagatgctggaagacgtggagatgttggaagacgagcagatgctggaagccctggagatgctggaagacctggagatataggaagacatggatttgttggaagacgtagcttagttggaagacatatattttctggaagacgtggattttctggaagacatggcttggttggaagacgtggattttctggaagacgtacctttgttggaagacatacctttgttggaagacgtacctttgttggaagacgtacctttgttggaagacacaagtaggctggaagacattaatttgatggaagacatggctttgttggaagacgtggatttgctggaagacacggatttcctggaagacctggatttttcggaagctatggatttgagggaagacaaggattttctggaagacatggatagtctggaagacatggctttgttggaagacgtggacttgctggaagacacggatttcctggaagacccggattttttggaagctatagatttaagggaagacaaggattttctggaagacatggatagtctggaagacctggaggccattggaagatgtggattttctggaagacatggcttttttggaagacgtagattttcaggaagacccaaattatccggaagacttggattgttgggaagacgtggattttctggaagactgggaggttactggaagacatggattttctggaagacatggattttctggaagacgtggatcttcaggaagacatatattggctggaagacctggattttttccggaagatgtggattgactggaagacctggatttggtggaagacgtagatttttctggaagacactgactgactggaagacctggatttctttctggaagacactgattgactggaagacctggatttctttctggaagacactgattgactggaagatctagatttttctggaagaactagatttactggaagacttggatttggtggaagacacagatttttctggaagacatggattagctggaagatctgtatttgatggaagaccttgaaattattggaagacatggatttcctggaagacgtggattttcctggaagatctggatttggtggaagaccagtaattgctggaagactggatttgctggaagacttgatttactggaagacttggagcttcttggaagacatggattgtccggaagacatggattgtctggaagatgtggattttctggaagctcaggattatctgg

SEQ ID NO: 5465 - DNA, 2702 bp, Homo sapiens
gccaaagtgccacgttgggcccggcggcggcgtgaagactggcggctgcgtgagactccggctccaggcgttcgcaccgtaatgcccggccgttggggccgtcggtaggcgcgaggcgagtcgaggcagccggccggtcggcggccgccggcgggaacggggctgaggcggcgcagcggagtctgggcggcggcgcgtcccgcccgagggcggctctggctgagggcggaggggccggggaagagcccggggcagcggctgaggcgggacggcggcgggggccgctgcccctagaagacccagccgagatgctggcggaaaacctggtagaggagtttgagatgaaggaggacgagccgtggtacgaccaccaggacctccagcaagatcttcaacttgctgctgagcttgggaagacattactggatcggaacacagagttggaggactctgttcagcagatgtatacaaccaatcaggagcagttacaggaaattgagtatctgacgaagcaagtggaacttctacggcagatgaacgaacaacatgcaaaggtttatgaacaattagacgtcacagcaagggaactggaagaaacaaatcaaaagctagttgctgacagcaaggcctcacagcaaaagattctgagcctgactgaaacgattgaatgcctgcaaaccaacattgatcacctccagagccaagtggaggagctgaagtcatctggccaagggagaaggagcccgggaaagtgtgaccaggagaaaccggcacccagctttgcatgtctgaaggagctgtatgacctccgccaacacttcgtgtatgatcatgtgttcgctgagaagatcacttccttgcaaggtcagccaagccctgatgaagaggaaaatgagcacttgaaaaaaacagtgacaatgttgcaggcccagctgagcctggagcggcagaagcgggtgactatggaggaggaatatgggctcgtgttaaaggagaacagtgaactggagcagcagctgggggccacaggtgcctaccgagcacgggcgctggaactagaggccgaggtggcagagatgcgacagatgttgcagtcagagcatccatttgtgaatggagttgagaagctggtgccagactctctgtatgttcctttcaaagagcccagccagagcctgctggaagagatgttcctgactgtgccggaatcacatagaaagcctctcaagcgcagcagcagtgagacgatcctcagcagcttggcagggagtgacatcgtgaagggccacgaggagacctgcatcaggagggccaaggctgtgaaacagaggggcatctcccttctgcacgaagtggacacgcagtacagcgccctgaaggtgaagtatgaagagttgctgaagaagtgccaagaggaacaggactccctgtcacacaaggctgtgcagacctccagggctgcagccaaggacctgactggagtgaacgcccagtctgagcctgttgccagcggctgggaactggcctctgtcaacccagagcccgtgagttcccctacaacacctccagaatacaaagcgttgtttaaggagatctttagttgcatcaagaaaactaagcaggaaatagatgaacagagaacaaaataccgatcactctcctctcattcttaattgaacctctagctctactactaatttgcctattgcctatcgcctctctctcccattcagacaagtgtttgtagactctgaagcctaatgttactcatgacgtttgcctcattgctttgcttatttagcaaatgcatacaacgaggaaaggaggtggctagtggtatcagttctctgatccacttccatttaagctccccaggaaatcccatgacaaactggcctctggctggcgcgctgattagacttcagttcctgaaaaggaccagtggagggaagagctatacttctggagaagtaggcctggagttactacagtatgggggaaaagggtcgagttagaacaaagctaaggcaattcctattgcttccttgcgcaacttctcaaaacgatgaaagtcagaaggctgtcaaactcaaatatctttgcaaacagtttgaatactgtgaattcattacgaagaatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatccctgtattctaatgtttttactcaaagctctagcctttaggataggtgaatatgtaaatcttttatcactttctcaaattcaaactaaaggggaaagatcaaaccccttcccttcctacctgttttctgagctggctgacttgccagccacaagctgctcttgcagagttcttaccattcctgtaaatgttttgacttgttgcagaaattcctatctactttattaagcagtattgatctgactgtggaaacatcctctcacttgcattcttttaacttaaaactatttaagaactgatgttccgattattgtatatatttttctaaaaaccaaataaagctacctatgaaaatgaa

SEQ ID NO: 5466 - DNA, 2346 bp, Homo sapiens
gggctgttgatttgtgggggattttgaagagaggaagagtaggaggaaggggttgaggggctgcctctggcatatgcacacactcacacattctgtcacacccgtcacacacacataccatgttctccatccccccaggtccagccctcagtgctgtcccatccagcagggctgccctgaagctctggctgcagccctcccgtccagtgggcaggcggcttcatccctcctttctctcccaaagcccaactgctgtcactgcatgctctgccaaggaggagggaactgcagtgacagcaggagtaagagtgggaggcaggacagagctgggacacaggtatggagagggggttcagcgagcctagagagggcagacgatcagggtgccggcggtgagaatccagggagaggagcggaaacagaagaggggcagaagaccggggcacttgtgggttgcagagcccctcagccatgttgggagccaagccacactggctaccaggtcccctacacagtcccgggctgcccttggttctggtgcttctggccctgggggccgggtgggcccaggaggggtcagagcccgtcctgctggagggggagtgcctggtggtctgtgagcctggccgagctgctgcaggggggcccgggggagcagccctgggagaggcaccccctgggcgagtggcatttgctgcggtccgaagccaccaccatgagccagcaggggaaaccggcaatggcaccagtggggccatctacttcgaccaggtcctggtgaacgagggcggtggctttgaccgggcctctggctccttcgtagcccctgtccggggtgtctacagcttccggttccatgtggtgaaggtgtacaaccgccaaactgtccaggtgagcctgatgctgaacacgtggcctgtcatctcagcctttgccaatgatcctgacgtgacccgggaggcagccaccagctctgtgctactgcccttggaccctggggaccgagtgtctctgcgcctgcgtcgggggaatctactgggtggttggaaatactcaagtttctctggcttcctcatcttccctctctgaggacccaagtctttcaagcacaagaatccagcccctgacaactttcttctgccctctcttgccccagaaacagcagaggcaggagagagactccctctggctcctatcccacctctttgcatgggaccctgtgccaaacacccaagtttaagagaagagtagagctgtggcatctccagaccaggcctttccacccacccacccccagttaccctcccagccacctgctgcatctgttcctgcctgcagccctaggatcagggcaaggtttggcaagaaggaagatctgcactactttgcggcctctgctcctccggttcccccaccccagcttcctgctcaatgctgatcagggacaggtggcgcaggtgagcctgacaggcccccacaggagcccagatggacaagcctcagcgtaccctgcaggcttcttcctgtgaggaaagccagcatcacggatctcagccagcaccgtcagaagctgaaccagcaccgtatgggctagggtgggaggctcagccacaggcagaagggtgggaagggcctggagtctgtggctggtgaggaaggaaggagggtgtattgtctagactgaacatggtacacattctgcatgtatagcagagcagccagcaggtagcaatcctggctgtccttctatgctggatcccagatggactctggcccttacctccccacctgagattagggtgagtgtgtttgctctggctgagagcagagctgagagcaggtatacagagctggaagtggaccatggaaaacatcgataaccatgcatcctcttgcttggccacctcctgaaactgctccacctttgaagtttgaactttagtccctccacactctgactgctgcctccttcctcccagctctctcactgagttatcttcactgtacctgttccagcatatccccactatctctctttctcctgatctgtgctgtcttattctcctccttaggcttcctattacctgggattccatgattcattccttcagaccctctcctgccagtatgctaaaccctccctctctctttcttatcccgctgtcccattggcccagcctggatgaatctatcaataaaacaactagagaatggtggtcagtgagacactatagaattactaaggagaagatgcctctggagtttggatcgggtgttacaggtacaagtaggtatgttgcagaggaaaataaatatcaaactgtatactaaaattacattttaaaa

SEQ ID NO: 5467 - DNA, 2206 bp, Homo sapiens
gcctcctttgcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcctgtgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccagactaaacttgatactgtattattttgttcaatgtaaattgaagaaaatctgtaagtaagtaaaccttaagtgtgaaactaaa

SEQ ID NO: 5468 - DNA, 1468 bp, Homo sapiens
ctttgcgggtaaacagacatggccggcgaaggagatcagcaggacgctgcgcacaacatgggcaaccacctgccgctcctgcctgtacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagctt

SEQ ID NO: 5469 - DNA, 2203 bp, Homo sapiens
gcctcctttgcgggtaaacagacatggccggcgaaggagatcagcaggacgctgcgcacaacatgggcaaccacctgccgctcctgcctgagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcctgtgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccagactaaacttgatactgtattattttgttcaatgtaaattgaagaaaatctgtaagtaagtaaaccttaagtgtgaaactaaa

SEQ ID NO: 5470 - DNA, 1894 bp, Homo sapiens
ggggcgcggccggggcggagacttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaa

SEQ ID NO: 5471 - DNA, 2471 bp, Homo sapiens
gaagaagtgagcttggccagaggcacgctgtttaatttcaaagtgctgctgactcaaactcatgagtcctggaggcaggtagaggcacttgtaggctgaggacccgtagagcccggtgtgccctgcccaagccccacctgggaatggagttatctctgtaaagatcttgctgcctttgagcaagcactgcaaatggggtaactggaacagccttgtcgcgtgtttccacccttcgtatgaggcaggtaccatgggtcttcaccaacagcacggcctgttgtctccaggaaatggtagcccctcacagtgctttctgtctgcttgtttagctttggcatttgaatgtgcagaatggtggactttgaaattaatgtccttctgttgactgcagaatttctgctggaaatgcagggaggctgcttgtggggttcgcgtgctgtgggaagtagggaaaatgagctggtttactttgtgtctttttgtgcatgcagactgtttggattttgccaacagtttctgggtgctgcctgctttttaaacttttaaaaaattgtaaacagcttcagtggctttgcagaaggaagctgtggtttctggtcttcctgttcagtcatgtttttttcagagggagggctaacatctggccatatttttcaacaaattcagaagtgagtagagaatgcatagtagctgtcggcagaggaggaaccagaatctctccaaagaaattcctcaaacagaatttcacacagggtattccatggagaatgagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataattt

SEQ ID NO: 5472 - DNA, 2471 bp, Homo sapiens; identical to SEQ ID NO: 5471

SEQ ID NO: 5473 - DNA, 1719 bp, Homo sapiens
gcgcggccggggcggagacttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtcgctgcggaggagctttgctgtctgctaggccaggtcttccaggttgtttacacggagtccaccatcgactttctggacagagcgatatttgatggggcctctaccccgacccaccacctgtccctgcacagcgatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagc

SEQ ID NO: 5474 - DNA, 2844 bp, Homo sapiens
cccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagggctcccattaatcacatattgatatttattttatttttcatgccctttcatttttctctcatttttcctattctttactcttcccaatgccttctgggaatgtttcaaaccactctccgtcttatgaattcattcctcaactgtattcattcaaccctgaattaaattgtttgtttctactatatctgattggtccttttttataactccttgtccctatttgtttccagtgccctcctacatgcccttgagaatatttattaggattattgtaaattcttgttttctctggcttatcagttcttctccctccagaattagttgtttagtttgtgatcttgcctttccagtgcttgaggtctgtgttccacagatctgtctttattttttccattccctccagcctgggtgacagagtgagactttgcctcaaaaaaacaaaacaaaacaaaacaaactcagacaaacaagatatgtttttgaacaatgaatatgtggatatcaaaattaaatcaataccattcacaatcacttaaaaaatgaaacacgggtataaatcttacaaaacatgaataagatttgtatgctgaaaactatagaacactgatgaaagaaatcaaagatctgaataagtggagagacacactgaattcatggattggaagactcaacctaattagtatgttacttgtccctaagttgatataaatggaccaactccttgaaaagcacaaactactactacaagtcatccaatatgaaataatttgaatagcttgtaactattaaaagtgaattctacaattcctatcaaaatttcagcaagaattttttgtagatataaacaagactattcttaaagtgcagtggcacgatcttaaatttcaagctattcttgaaatttaaatggagaggcaaaataagtagaatagctaataataattttgaaaaagaagaaaatgagaagagtcagcctgtctgatttcaagatagatcatactgctatcacaatcaagactgtggtatctgcagagggactgacacagagatcaggggagcaaaatgaactagaaacagatccacacatatatgcccagctgattcttgacaaaggttcataagcaattcagtggagaagggataggatagccttttaacaaatggtgctggagcagttggacatttgtaggcaaaaattgaaccttgccctgaatttcacaacttaaacacaaaaattaactcaaaatggatcataggcttaaatataaaatacaacttctaggataaaacatagaaaatcttcaggatgcagggctacgcagagttctgagacttgatacctaaagcataattcataaaagaaaaaactgataaactggacttcatcaaaatttaaaactcttgctctataaaagacaatgaaaacatatgctacagactgagaggagatatttttaaaccacatatctgacagagggttggtatctacagtatataaagaactctcaaaactcaacagtaaaacaaacaatccgattaagacataagcaaaagacaggaggagatacttcaatgaagaggatatacagatggcagtaagcacatgaaaatatgctcagcatcattagccatcagggaaatgcacattaaaaccataatgagctgccaatacacacctaacagaatgtttaaaaaaagtagaacacaagatgctggagaagatgtggaggaactggacccctcattcattgctggtagggatgtaaaatggtaccgccactctagaaagcagtctggcagtttcttcaaatctccacgtgcaactacgaacaacttggcaattgcactcctaggcatttatcccagggaaatgaaaatttatgttcacatgaaaacctgcctactaatattcaaaacagttgtattcatagtagcccaaaactggaaacaactccatgtcctttggtggataaatggttaaacaaaatgaggtccatccatgccacagaagactattcaataatacaaagggctgggcatggtggcacctgcctgtagtcccacctactggggaggctgaggctggaggattgcttgagcccaggaagtccaggctgcagtgagccatgatcatgccactgtgctccatcctggatgacagtgagaccctgtcttaaagcaacaacaaaggaacaaactacacagcaacctggatgggcctccagagaattatgttgagtgaaaaaagccgttcctaaaggtttcacactgtatgttcctttctgtaacatctttgaaatgacacagttgctgaggtggagaacagattagggtttgctaggggtggagagaagtaggtgtgcctataaagggcaacaggaggggtcctcacagtgatgggtgctctggctgtgtttacatccatgtcctggtgtgatgtgctgtagttctgcaagatgtcactgctgggggcaatagggtaaagggagcgatggatctccctgtatcatttcttataataagagaatttacaattaccttaaaataaaagtttaatt

SEQ ID NO: 5475 - DNA, 1620 bp, Homo sapiens
gcgcggccggggcggagacttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaagtatttaggtcagttaacgtccataccaggatacctgaatccctccagtaggactgaaatcctgcatttcatagacaatgcaaagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacagatgactcttctacaaaagtggacattaaggagacctacgaggtggaagccagcactttctgcttccctgaatctgtggatgtgggtggtgcatcaccccacagcaagaccatcagtgagagcgagctgagcgccagcgccactgagctgctgcaggactacatgctgacgctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagc

SEQ ID NO: 5476 - DNA, 4064 bp, Homo sapiens
tttttttttttttttaaagctgttcctgctgattgctttttaagctaggctcaagtgtggggccacggaatccttcaggtgcccttcaaatcagacattacatttcagctctcagggctagaatgcttccccctcttatcttgggcaggtctttgaagaagccagtttagccttggtaattttgaatttggccatagtatacggaggagagctaggtagctatcaaaacgcttagacaaacgtatggtaaaatgcagcccagcctgaacctccgcaaaacccccaaacctggagcagcaagtgggcaaaggagtgtgtgtttggggcagggtactgagtcccatatgtaatcaagagacctggagggcccaaggaagtcagtgacacccccacaagctacatatcctccaatggattgtggtggtcatctccggctaccgaagccaccttgcttattcccataggcttacaaacattatgatgcttcacacgagttgtgggtgaagtgaaggaattggaaagtcccggtctaaggccctgcaaaactgctgtctggtaaaaacaagtgactatggcaaggccctgaatgtactacgtatagacttaagtcagtatttgtgcctaacagcaaagcatgccacaagaggctcctcaaaagccgggtaattgatgccattgttttcttgacctagttgaagagtcaaagaagagaaggtgatgcagaaacttctttccagtgaagtgacagatccaagcaaggaacacctgcctgtgaggggagcggtaggggagggggtagattcggcagcactcgggtagtggcagggaccacatattgtcggtgttaaccactgttatcactggcccaggtcgagtgaggacgagtcatttccccactaagcacttggggagtggcagggaccacatattgtcagtgttaaccactgttatgactggcccaggtcgggtgacgacgagccatttccgcactattgtcccttcttcctcactgcacccccagccctgcaccctcagctccaaatacacattctcgttcactcaacgtttgttgacacctagcgtgggccctgtgggatggggtaaaagttcggtgttgggaggagccccggtgacagatttttggttttggtggtggcttttgggcaaggacaggtcaattcataaaagatgacgccccaggtctggatcgaattctcctgggagccagaccaaagcaccttcctggactgcaaagtgtggaagccgccgcgggccgggcgcggggaggtgtcatgcgccggaacctgcgcttggggccaagctctggagctgacgcgcaggggcaaggcgccccgcgtcccggactggcggctccgcgcatgctcctcccaccggcgtcgcaggcctcgagaggctccggaagtactgggtgcagcctgatggcgcaggaggtagacacggcacagggcgccgagatgcggcggggcgcgggcgcggctcggggacgcgcttcctggtgctgggccctggcgctgctttggctcgcggtggttccgggctggtcccgggtctcgggcatcccctcccggcgccactggccggtgccctacaagcgctttgacttccgtccaaaacctgatccttattgtcaagctaagtatactttctgtccaactggctcacctatcccagttatggagggtgatgatgacattgaagtttttcgattacaagccccagtatgggaatttaaatatggagacctcctgggacacttgaaaattatgcatgatgccattggattcagaagtacattaactggcaagaactacacaatggaatggtatgaacttttccaacttggcaactgtacatttccccatctccgacctgaaatggatgcccctttctggtgtaatcaaggcgctgcctgcttttttgagggaattgatgatgttcactggaaggaaaatgggacattagttcaagtagcaactatatcaggaaacatgttcaaccaaatggcaaagtgggtgaaacaggacaatgaaacaggaatttattatgagacatggaatgtaaaagccagcccagaaaagggggcagagacatggtttgattcctacgactgttccaaatttgtgttaaggacctttaacaagttggctgaatttggagcagagttcaagaacatagaaaccaactatacaagaatatttctttacagtggagaacctacttatctgggaaatgaaacatctgtttttgggccaacaggaaacaagactcttggtttagccataaaaagattttattaccccttcaaaccacatttgccaactaaagaatttctgttgagtctcttgcaaatttttgatgcagtgattgtgcacaaacagttctatttgttttataattttgaatattggtttttacctatgaaattcccttttattaaaataacatatgaagaaatccctttacctatcagaaacaaaacactctctggtttataaaacaccttaattctactgctcttttttctccaatcaccagcatctgtttttcagggggtgattttacttttgtgaattccttagcctttcttccttggtgcataaagttaaaatgcacatcagcagaattgctgcatattaacatctcaggactcttctcttgtaaagaagctgaaattcgtactatattggccaaagtgagcgagttaggtgatcttggtttcaatttccgagcctttgttaatatggagaattatggttcatatcagttatgtaggacctttggacccagggtcctacagatagatatggtgtgcccagattttaaaaataccttcaaaaataaaaaatacattcagtgacattttcatggtgggagctcttctttctgatatggcagttacactttttcacttaagtgctttagtttagactaactttacaacttctataacttttggaaccaagtttagtatagtctgattacattccattcacctaactttagacattcgtttagacaccataactggagtgattgtgcttctagatgtggcaaatccagtgttaacacatatttctggctgagattttggaactagctagtaactggcttgtgttctttaagcatactaacatcactaaatcttaggatttaggattgctgtaaagatgtaagttgtgtatgtttggcaggtcacattgaatggcagtgataatgattaatcaaagaacaaatgtcatccttgatcttgcctaatgtagtttatgtgccaaactttccagggttttgtagtcacctagattttaagctgatagcatagtgcttcagcggttcttctaaccggggtatgcaggaacatggctgcagacacgtttgggtaaacaggcaccttctgacttcttcattgtttcctgtagttctccctcttcccacaaagctgtcagcgcagtggaagaggttgcacttctccgagagaggacaggtttctgttaagatcaccaagtagctgtgctttaattagagccagacaagctttcaaggtcctttaagtatttgatgatcaactgaacacgtttctattcaaggagaaaacaccattcagtaagaagatggagtagatatcagataaaacaattcacgtttaatatgtaaatgtaccaattatgtgattcagtttcaactttcaagtacttcctgagaggttagtacattattattgagctctcacagaaagcttaatcatagatataattaacctgatccaaatgagtaaagtggaccttagaaaggctaagtgatctttctctggctatccagctagtagtaatgaagtcaggtcttgaaccccggttctgctgactgaattggatgcactatagtacaggcttttagcaccgaagtgtggtcctcagaccagtgcctgccaaccagatgttactggtctgtgaggaaataagtacagatactgacaggaagcttttataaacaatttattggagtgtttttgtttctgttgggtctaattaaaaaaattggagcttgta

SEQ ID NO: 5477 - DNA, 1407 bp, Homo sapiens
actgggtgcagcctgatggcgcaggaggtagacacggcacagggcgccgagatgcggcggggcgcgggcgcggctcggggacgcgcttcctggtgccctacaagcgctttgacttccgtccaaaacctgatccttattgtcaagctaagtatactttctgtccaactggctcacctatcccagttatggagggtgatgatgacattgaagtttttcgattacaagccccagtatgggaatttaaatatggagacctcctgggacacttgaaaattatgcatgatgccattggattcagaagtacattaactggcaagaactacacaatggaatggtatgaacttttccaacttggcaactgtacatttccccatctccgacctgaaatggatgcccctttctggtgtaatcaaggcgctgcctgcttttttgagggaattgatgatgttcactggaaggaaaatgggacattagttcaagtagcaactatatcaggaaacatgttcaaccaaatggcaaagtgggtgaaacaggacaatgaaacaggaatttattatgagacatggaatgtaaaagccagcccagaaaagggggcagagacatggtttgattcctacgactgttccaaatttgtgttaaggacctttaacaagttggctgaatttggagcagagttcaagaacatagaaaccaactatacaagaatatttctttacagtggagaacctacttatctgggaaatgaaacatctgtttttgggccaacaggaaacaagactcttggtttagccataaaaagattttattaccccttcaaaccacatttgccaactaaagaatttctgttgagtctcttgcaaatttttgatgcagtgattgtgcacaaacagttctatttgttttataattttgaatattggtttttacctatgaaattcccttttattaaaataacatatgaagaaatccctttacctatcagaaacaaaacactctctggtttataaaacaccttaattctactgctcttttttctccaatcaccagcatctgtttttcagggggtgattttacttttgtgaattccttagcctttcttccttggtgcataaagttaaaatgcacatcagcagaattgctgcatattaacatctcaggactcttctcttgtaaagaagctgaaattcgtactatattggccaaagtgagcgagttaggtgatcttggtttcaatttccgagcctttgttaatatggagaattatggttcatatcagttatgtaggacctttggacccagggtcctacagatagatatggtgtgcccagattttaaaaataccttcaaaaataaaaaatacattcagtgacattttcatggtgggagctcttctttctgatatggcag

SEQ ID NO: 5478 - DNA, 2120 bp, Homo sapiens
actgggtgcagcctgatggcgcaggaggtagacacggcacagggcgccgagatgcggcggggcgcgggcgcggctcggggacgcgcttcctggtgctgggccctggcgctgctttggctcgcggtggttccgggctggtcccgggtctcgggcatcccctcccggcgccactggccggtgccctacaagcgctttgacttccgtccaaaacctgatccttattgtcaagctaagtatactttctgtccaactggctcacctatcccagttatggagggtgatgatgacattgaagtttttcgattacaagccccagtatgggaatttaaatatggagacctcctgggacacttgaaaattatgcatgatgccattggattcagaagtacattaactggcaagaactacacaatggaatggtatgaacttttccaacttggcaactgtacatttccccatctccgacctgaaatggatgcccctttctggtgtaatcaaggcgctgcctgcttttttgagggaattgatgatgttcactggaaggaaaatgggacattagttcaagtagcaactatatcaggaaacatgttcaaccaaatggcaaagtgggtgaaacaggacaatgaaacaggaatttattatgagacatggaatgtaaaagccagcccagaaaagggggcagagacatggtttgattcctacgactgttccaaatttgtgttaaggacctttaacaagttggctgaatttggagcagagttcaagaacatagaaaccaactatacaagaatatttctttacagtggagaacctacttatctgggaaatgaaacatctgtttttgggccaacaggaaacaagactcttggtttagccataaaaagattttattaccccttcaaaccacatttgccaactaaagaatttctgttgagtctcttgcaaatttttgatgcagtgattgtgcacaaacagttctatttgttttataattttgaatattggtttttacctatgaaattcccttttattaaaataacatatgaagaaatccctttacctatcagaaacaaaacactctctggtttataaaacaccttaattctactgctcttttttctccaatcaccagcatctgtttttcagggggtgattttacttttgtgaattccttagcctttcttccttggtgcataaagttaaaatgcacatcagcagaattgctgcatattaacatctcaggactcttctcttgtaaagaagctgaaattcgtactatattggccaaagtgagcgagttaggtgatcttggtttcaatttccgagcctttgttaatatggagaattatggttcatatcagttatgtaggacctttggacccagggtcctacagatagatatggtgtgcccagattttaaaaataccttcaaaaataaaaaatacattcagtgacattttcatggtgggagctcttctttctgatatggcagttacactttttcacttaagtgctttagtttagactaactttacaacttctataacttttggaaccaagtttagtatagtctgattacattccattcacctaactttagacattcgtttagacaccataactggagtgattgtgcttctagatgtggcaaatccagtgttaacacatatttctggctgagattttggaactagctagtaactggcttgtgttctttaagcatactaacatcactaaatcttaggatttaggattgctgtaaagatgtaagttgtgtatgtttggcaggtcacattgaatggcagtgataatgattaatcaaagaacaaatgtcatccttgatcttgcctaatgtagtttatgtgccaaactttccagggttttgtagtcacctagattttaagctgatagcatagtgcttcagcggttctgctgactgaattggatgcactatagtacaggcttttagcaccgaagtgtggtcctcagaccagtgcctgccaaccagatgttactggtctgtgaggaaataagtacagatactgacaggaagcttttataaacaatttattggagtgtttttgtttctgttgggtctaattaaaaaaattggagcttgt

SEQ ID NO: 5479 - DNA, 2242 bp, Homo sapiens
gtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctgatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgcgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagtcacagccccaa

SEQ ID NO: 5480 - DNA, 945 bp, Homo sapiens
gaatttgcggcggcctccgccggggcagccgagctgaaccggtctcttcctcggaaaggcagggccgaggggcctgcggggcagccatggaggcgacgcggaggcggcagcacctgggagcgacgggcggcccaggcgcgcagctgggcgcctccttcctgcaggccaggcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtgtgtcttgtatatgtgtgcgcagagtgcatcattttcagactctactattt

SEQ ID NO: 5481 - DNA, 1343 bp, Homo sapiens
agaagtcaggccaggtgtctctctttcccttgggcccgcggcccaaccgcatggcaccaggcagcccccagcggtattgcgacctctgcgtcagtcgcgctcagtccctagatacaggtgtgccggagaagcccagggaagggatgcgtgaccatcactacaccctgccccacgacgcggtgggacgcgcaccctgaccctccccagagccgcgcccaggaccttgcctgggcggaaaatggcagccgttgccgggaaggagcggcgagcgagaggcaggccccggccagagacactgggagccatccctaggagggagggaggcgaggcgggcttgagccgagccttcaagccactggcgcaggcgccattgtcctgtgagacttcgctgagaaaactcaaattcaaaggtaaaaagcatggctctgtgagcgctgatgaggctgcccgcacggctcccttccacctcgacctctggttctacttcacactgcagaactgggttctggactttgggcgtcccattgccatgctggtattccctctcgagtggtttccactcaacaagcccagtgttggggactacttccacatggcctacaacgtcatcacgccctttctcttgctcaagctcatcgagcggtccccccgcaccctgccacgctccatcacgtacgtgagcatcatcatcttcatcatgggtgccagcatccacctggtgggtgactctgtcaaccaccgcctgctcttcagtggctaccagcaccacctgtctgtccgtgagaaccccatcatcaagaatctcaagccggagacgctgatcgactcctttgagctgctctactattatgatgagtacctgggtcactgcatgtggtacatccccttcttcctcatcctcttcatgtacttcagcggctgctttactgcctctaaagctgagagcttgattccagggcctgccctgctcctggtggcacccagtggcctgtactactggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagta

SEQ ID NO: 5482 - DNA, 7113 bp, Homo sapiens
gtgcgcgggcggtgtttgaggccggccagtcgtgactgggcggcaatgaggtcagtgactgccgggagtcctgcaggggcggggcggcgccaagcgcagggagcccggctgagtggcagcccagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggatgctcttaaaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagcttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgtaatcccagctatttgggaggccaaggcaggagaattgcctgaacccgggaggcggaggttgcagtgagctgagatcgcaccactgcactccagcactccagcctgggtgacagagcaagactctctctcaaaaaaaaaaaaaaaaaaaaattctagaccgaagtgtacggcagtgccatctggtggcaagtggtacaaagacaacgctgaggggtagtgactcctgtagcagcagagacgccttggagtttaacccccaccaaccagagcgtgggctggtaaagatgaaatcttgcaagttttttttttttttaaatcatggtacctgttttaaaatgagaagttattattcatactgtgttgctcatttgacaaaataaggtaaggatttcataatcaggttgtctgggtttcagagctgtttttaattgactgagttacctacaggcacccaatctagaccctaattctgtggttggtgttcctctgtagatttcaagacaagtagtgatgtcattttctccctgagctgtagggtggacctggacccctcagagatgctcgactgcagggtcctggggtccctagagtggtcctgcagcagcccctggcaatgagctgcctgatgatgagtcccaaggtacattgttctactgttttatacccaggtagaagttacacagcaatttagcaatgttgttaacagacatacagaattgtgtgtgtgtgtgtgtgtgtgtgtgtgagtgttttgatataaacgtgcaattaaaattcaaagtttattttttatcacaagcacctttgaaatgtacgtggaaaacgtcggctgctcgtgagaatcatgtgtgacttacgttccttatgttttatggaactctcggaacagtgttttgtttttgtttagtttttgttttcgtttttttgagacggagcctggctttggctcccaggctggagtccagtggtgtgatctcggctcactgcaacctccacctcccgggttccagggattctcctgcctcaccctttcaagtagctgggattacaggtacctctaccatgcctggctgattttttgtatttttagtagagacagggtttcaccatgttggccaggctggtctctgactcctgactaaaagtgatctgcccacctcggcctcccaaagttctgggattacgggcgtgagccacttcacccggcccggagcggtgtattttgattgctggtgctttaactatattgaccaaggtgtatagtaacctatttatcacattttacgaagcaattttaatcttaaacacatccagcaaatggtgtccctgctgaaacttttaactggaaacctcacacctggcaggcagcactctctgcagccgtgcccttgtggagtcagcaggagctggtgtttttcagccagacagaggcataataaagtgactgatgtttacagaacccaaatgatgtcttcctctctctcaaaataaactaacctattcatattgctgtgaatgctttatcttggagatagaaaatataatgataaattcatcatgtgttcagaattcgatttggagttggaagtggacagcctaatttttatctcacctccactaggactttgaccttcccaggggtccacactttacctcctgtatcttcatacgcgtgtgtggatgcatagagatggaggtgctgtagagaagcacaggctcacccgctccgtccagtgtcacccacacattggtccggggacccctcagtgcagagcctgaagttgggggtttaggggtggaaaaggcttcgtgaaatgttaatgatgcgtacaccttccagatggcacagcactttcccatggtcctcactggcctcagtctccctgaccggcagtgtgaggggatgtagctatagtggagcatggtacaagcgacattcatgagctctgacttcttggtgccaggttggtgtgagcctgggcccggcccactcagcggcccacattggccagcattcagctgcacgtgtgtgctgcgtgcttcacatcctctattgagagttacagcaagtgttaaacgaggtgagttcacataacaggaattctggaactgcttgaaaactaggacgattgggcaatatcggccttaactccacctgatggcaggtgacccggatagaaaatggccctgcgtttagccaggatgtggctctccagcttggcttcagtgtgatcacttgtcagtgcgctttctctttcgatagtgaaatccttctctatacctatgttttgttttgtttcttaagttgggaaacagaatgggccagggaggttgagtgactgaagaccaagggttggtgcagcctcctcgccgcgctgcgggggctgggccgcacaggcttctgcccttctcggtgtccaggctccttgggtgatgctggagttgtcatggccgcagttcagtgtgagattttttaccaggtattgcgcttaagggacatgattttccattttcttcgcccggacaacttgaatgaaatgggcactgttgattccacttctgtcgaggagcttcggggctcagagaggtgatgacgtgcccaaggtgacgcaactcgtgaacagccgtgcctgccttgggcgcagcctccggcgccagagctgggctcttcaacacggcatttagcgcagaaagtcgtggttcaggcagtatgggccgctgtgacaaaacacctaagactgggtagtttataaagaacagacattcaggccaggcacggtgactcacgcctgtaatcccagcactttgggaggccgaggcgggtggatcatttgaggtcaggagtttgaaaccagcctggccaacatggtgaaaccccatctctactaaaaaaacaaaactagctgggggtggtggtgcatgcctgtggtcccagctacttgggaggctaaggtagaagaattgcttgaacctgggaggcagagattgcagtgagccgagatcacgccattgcactccagcctgggtgacacagtgagactccatctcaaaaaaaaaaaaagaacggacatcatttctcacagttctggaggctggaagtccaagataaaggtgtgggctgattagtttctgctgggaacactgcatcctcacgtggtggaggggatggaaggtcaacaggcctcagctagttctccgctgcctttttatgaggcattaagccatttgcaagagtagggggccccacctcttaataccaccgcaatgacaattacaatgtcatgtgaattctggaggggacacggtcacactgcagcatcagcacccggtgaatgtggttctcttcccatgtccgaattttgtgagctccacacgggcagggttgcatctgttttattctctgattgattctaagccccatgtccctggcacaggatggctgcttggcagtagggagtggatgaaccagtagtacccagggctgccaggcagggccctgcaggggacagacccaagggctgatatggggacacctgctgaggggggaatttaccacggtaagggcagggctgggaggctgggcagccagtttcaccctcgcacaggctgcctggcaagaccagcggctggaggtgatgtcctcagtagagaacggtggccactggaaacgtgtggccagaaggggaaacgctcgggcctctggtgggggccagcctggggtggggtcggccagggtcagctgcctttccttcatgctggggaggagatgttgtgtgcatgtgagaaagcatttgatagcatgccaaaagtttcctccattatgtgcgtgtcaagtgtttgaccaggtcagaactcttgttctatgcgaatgtgctcacgcagacagaagcggaggggctccgtcgctctgccctcacgccgctgaaccgcgagggtctcccgctcctcaggcttgcggctcggccgcgaagtgtgtcaggtgtgcatcctgggtgctcctttgtgctctgtcctacggtgacacaggcggcgtggggttagacaggtaccggtcagactacggtgacacaggcggcgtgcggttagacaggtaccggtcagattacggtggcacaggcggcgtggggttagacaggtaccggtcagattacggtggcacaggcggcgtggggttagacaggtaccggtcagattacggtggcacaggcggcgtggggttagacaggtaccggtcagattacggtggcacaggcggcgtggggttagacaggtaccggtcagattacggtggcacaggcagcgtggggttagacaggtaccggtcagattacggtggcacaggcggcgtggggttagacaggtaccggtcagattacggtggcacaggcggcgtggggttagacaggtaccggtcagattacggtgacacaggcggcgtggggttagacaggtaccggtcagattacggtggcacaggctgcgtggggttagacaggtaccggtcagattacggtggcacaggcggcgtggggttagacaggtactggtcagatgcacgggctccctaaacccctgctgtggcttcggcagtaaagacaggacgcacccatgtcacaagaggagcacaggcaggggtgttggtgttggggcagccctcagggtctccagaccccagccccactcacacagcagcctaggaaggaagggcagagtcccaggtgtcagctggtgggtctcccaggagctgcccctccctggaagtcacaggacaggaatgacagatcagggaactgcaggaagctgccacctctggggtcagaatatgcccagcctgcgggggctctctatcggggtcttcgagagccagacagcctgccttgtgctgcatacctggctttgctctgtgcagaacccagcacacgtgattttgtgtgacatgccagcagcctggctcccaggacaggaggcctgccctgggggaggggctgcaggaggagggggggcaggcacccatgagtctgtccagccttgtcacagatgcatcgcccaccctgcggtcctgatttcagctcacctcagagtaaatcagaataaactgcacccagactttcacgaatgcatgttgacgctttcagttcacccctttctttgctaactttcttcctattttcttctaatgcgagagcttattaattccatatttatcattttgaataacttttctcctttttagtaacaaaatgtacttcactcttagtaaaatgtatttactattttagtaacaaaaatatacttgcctaatcatgtttaaaatatagtgatgtgaaaaattcaga

SEQ ID NO: 5483 - DNA, 2037 bp, Homo sapiens
caaaaaagtttcaatccagagttgggttccagctttctgtagctgtaagcattggtggccacaccacctccttacaaagcaactagaacctgcggcatacattggagagatttttttaattttctggacatgaagtaaatttagagtgctttctaatttcaggtagaagacatgtccaccttctgattatttttggagaacattttgatttttttcatctctctctccccacccctaagattgtgcaaaaaaagcgtaccttgcctaattgaaataatttcattggattttgatcagaactgattatttggttttctgtgtgaagttttgaggtttcaaactttccttctggagaatgccttttgaaacaattttctctagctgcctgatgtcaactgcttagtaatcagtggatattgaaatattcaaaatgtacagagagtgggtagtggtgaatgttttcatgatgttgtacgtccagctggtgcagggctccagtaatgaacatggaccagtgaagcgatcatctcagtccacattggaacgatctgaacagcagatcagggctgcttctagtttggaggaactacttcgaattactcactctgaggactggaagctgtggagatgcaggctgaggctcaaaagttttaccagtatggactctcgctcagcatcccatcggtccactaggtttgcggcaactttctatgacattgaaacactaaaagttatagatgaagaatggcaaagaactcagtgcagccctagagaaacgtgcgtggaggtggccagtgagctggggaagagtaccaacacattcttcaagcccccttgtgtgaacgtgttccgatgtggtggctgttgcaatgaagagagccttatctgtatgaacaccagcacctcgtacatttccaaacagctctttgagatatcagtgcctttgacatcagtacctgaattagtgcctgttaaagttgccaatcatacaggttgtaagtgcttgccaacagccccccgccatccatactcaattatcagaagatccatccagatccctgaagaagatcgctgttcccattccaagaaactctgtcctattgacatgctatgggatagcaacaaatgtaaatgtgttttgcaggaggaaaatccacttgctggaacagaagaccactctcatctccaggaaccagctctctgtgggccacacatgatgtttgacgaagatcgttgcgagtgtgtctgtaaaacaccatgtcccaaagatctaatccagcaccccaaaaactgcagttgctttgagtgcaaagaaagtctggagacctgctgccagaagcacaagctatttcacccagacacctgcagctgtgaggacagatgcccctttcataccagaccatgtgcaagtggcaaaacagcatgtgcaaagcattgccgctttccaaaggagaaaagggctgcccaggggccccacagccgaaagaatccttgattcagcgttccaagttccccatccctgtcatttttaacagcatgctgctttgccaagttgctgtcactgtttttttcccaggtgttaaaaaaaaaatccattttacacagcaccacagtgaatccagaccaaccttccattcacaccagctaaggagtccctggttcattgatggatgtcttctagctgcagatgcctctgcgcaccaaggaatggagaggaggggacccatgtaatccttttgtttagttttgtttttgttttttggtgaatgagaaaggtgtgctggtcatggaatggcaggtgtcatatgactgattactcagagcagatgaggaaaactgtagtctctgagtcctttgctaatcgcaactcttgtgaattattctgattcttttttatgcagaatttgattcgtatgatcagtactgactttctgattactgtccagcttatagtcttccagtttaatgaactaccatctgatgtttcatatttaagtgtatttaaagaaaataaacaccattattcaagccatataa

SEQ ID NO: 5484 - DNA, 4495 bp, Homo sapiens
aatgctgctcggcggttgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggagatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgacaggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggatggtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacgaaaagatacacaatcattctgttttttgaaattccatgtgattcaaactgctccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttccacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttaccccagctaccgttaaatgaggacaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaaagattttgaaagcacattttgttttgtgagtcaatgacaaatatatttcctgattacaaaacagcagaa

SEQ ID NO: 5485 - DNA, 5298 bp, Homo sapiens
tttatcgtacttttcagaatttctgtggaatgtttaatcttctggatccatgactgtctgatacgttggcaatttaaagtccttttgaaagagagttcatgttacccagctattctctagtatgtattcatggaatactccatcgtttctgattacacttatgagacataattcttcagagcacacttagaattatttctctaacatatttatgcagacagaattccatcttgaattttatcaaattcactttaacttcttaagtcttggttattgtaagagcccaaaggtatggccccagggaacaattaagacttgatgatttgtcacctaccaaaatatgttcattatgtaaaggtttcaatgcccataaggctgtcatttggtatttagtgcagtgctcataaaagtgtgttattaggataaattgagaaattaattaagctgcttctagattaaataaatataaatatttggacaaatattgaagatacgtactttttccatcaaattttaattgaggttctgctgtatactagactctatgttcttgattttgttcttactagttaagtgaagtaagtattaacaaatgtaattattaattttaatgggaaaaggaaacaagtattagagaagtaagactttgcatatcttaacaccttttggaaaacggaggtatacatgcattacaaaataactttgaactgtatattttggctttacaatttaatgtcattgttgcttttagttgtatttggtctggtttttttttgtggtttttcctcagaacaattttggaaactatattcatcttcatatagaattatggcagtttataggcccacctgtttgaaaaaactttatccacagttgtgttcctaaaatcagttgtcccagaattgtgacaggaaagaagctcttttgaacttgaatgcatatctaagttagatgagattaatacaatttatatcctgaatgtaatttatatcctaaatgttgaactgtgattaggtttccctaaataatggtgacatctgggatagtttgagttctttctttatagtctaatttacttgaatttcgtaaaaatcaaggaatggacctgattgcgactggttagtaacttgttctagttttgccttcccttatatatttcaggtaagttaagattaatagacacacagtctactaatttgaattaagttttttgaagtatttgaagtgtttatatactgccttttattgttcattacttccagaatgaactgttgttataatactcatctttgtttcttttgtcttgaaagaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggagatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgacaggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggatggtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacgaaaagatacacaatcattctgttttttgaaattccatgtgattcaaactgctccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttccacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttaccccagctaccgttaaatgaggacaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaaa

SEQ ID NO: 5486 - DNA, 1063 bp, Homo sapiens
aaacgcagtgccctcacttgtggttccgggctggggacggagtgaagtcccacgtatctcaattaagggaagtgctgggtttatatggagaacatagactatccgcaagggagctggttaccgaaagagaagtccctcctccaaaagagcgccttggagggctgcgcaggtgcagatacctctactaagaagacagaagacttactttcatcatctgaatcaaatccaaagagtgtctgacatttcttttgtgcaagatgagcctcaagtgcttctgcattacataaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaa

SEQ ID NO: 5487 - DNA, 556 bp, Homo sapiens
agtgctgggtttatatggagaacatagactatccgcaagggagctggttaccgaaagagaagtccctcctccaaaagagcgccttggagggctgcgcaggtgcagatacctctactaagaagacagaagacttactttcatcatctgaatcaaatccaaagagtgtctgacatttcttttgtgcaagatgagcctcaagtgcttctgcattacaaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggact

SEQ ID NO: 5488 - DNA, 1147 bp, Homo sapiens
aaaccggccgtctgttggtcaatgctgctcggcggttgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaatttctgtggaatgtttaatcttctggatccatgactgtctgatacgttggcaatttaaagtccttttgaaagagagttcatgttacccagctattctctaaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttga

SEQ ID NO: 5489 - DNA, 2041 bp, Homo sapiens
agtgtgaaaggctgcgtttccggcccgtggggctccaatcaaaatgggacgcctgctggcggtaacgacaggccggggccccgccccccgaagtagggcgtgtggcgtcacttccggcttccttcagtccgctggtcccgagcacgagctgtgaggggattcacttgtgtgcggaactcctcggaaccatggcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 5490 - DNA, 2189 bp, Homo sapiens
gcgtgcggcctgcgccaggccagccggtggagctcaccacgagggggaggggtggaccgcaaagccagcgtctccttgtgcctaggtctttgcatagtcccggcagcccaggtccgcgcctcacccggagcgaagaaatttctagtgtgggacccgctccgccctccttctaggggcggagcctggagcgacggggtctgagccatcagagggtggaggggccgcagccttccgagggtggaagatggaggccgcgttccctcgcccgcccggcaggcgtcaccttgatggcctgcaacccctccctgcctcattcttagttcaagatcgtctttagtctcgctgcgtccctttcccttgcacctgttaacatctttaaggcaggagctgatgaagagagagcagagacagctcgtctgacttcttttattggtgccatcgccattggagacttggtaaagagcaccttgggacccaaaggcatggacaaaattcttctaagcagtggacgagatgcctctcttatggtaaccaatgatggtgccactattctaaaaaacattggtgttgacaatccagcagctaaagttttagttgatatgtcaagggttcaagatgatgaagttggtgatggcactacctctgttaccgttttagcagcagaattattaagggaagcagaatctttaattgcaaaaaagattcatccacagaccatcatagcgggttggagagaagccacgaaggctgcaagagaggcgctgttgagttctgcagttgatcatggttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggcttcctgttggataaaaaaattggagtaaatcaaccaaaacgaattgaaaatgctaaaattcttattgcaaatactggtatggatacagacaaaataaagatatttggttcccgggtaagagttgactctacagcaaaggttgcagaaatagaacatgcggaaaaggaaaaaatgaaggagaaagttgaacgtattcttaagcatggaataaattgctttattaacaggcaattaatttataattatcctgaacagctctttggtgctgctggtgtcatggctattgagcatgcagattttgcaggtgtggaacgcctagctcttgtcacaggtggtgaaattgcctctacctttgatcacccagaactggtgaagcttggaagttgcaaacttatcgaggaagtcatgattggagaagacaaactcattcacttttctggggttgcccttggtgaggcttgtaccattgttttgcgtggtgccactcaacaaattttagatgaagcagaaagatcattgcatgatgctctttgtgttcttgcgcaaactgtaaaggactctagaacagtttatggaggaggctgttctgagatgttgatggctcatgctgtgacacagcttgccaatagaacaccaggcaaagaagctgttgcaatggagtcttatgctaaagcactgagaatgttgccaaccatcatagctgacaatgcaggctatgacagtgcagacctggtggcacagctcagggctgctcacagtgaaggcaataccactgctggattggatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaac

SEQ ID NO: 5491 - DNA, 2150 bp, Homo sapiens
actgcgcaagcgcctgtgccctcccagtgccttcgtcgtgcgctctctgtctaacttgtctggccgttcttgcgtagggggcgggactaaggctgtcaattggtctgtttttgtgccgatcaatgagatgggtgcggtgattggcgactaccttgagagtagcgggttgaggtgtaagccctgaggaggcagcgttttctgggcttctgtctggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttga

SEQ ID NO: 5492 - DNA, 1815 bp, Homo sapiens
ctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttg

SEQ ID NO: 5493 - DNA, 2048 bp, Homo sapiens
ctctctccagaaggttctgccggttcccccagctctgggtacccggctctgcatcgcgtcgccatgatgggccatcgtccagtgctcgtgctcaagacggagtttcaccatgttgaccaggctggtctccaactgctgatgagctcaggtgatccgcccacctcggcctcccaaagtgctgagattacaggcgtgagccaccgcgcccggtcccttatttttttctgatgagcaccacctccattgtcttcctttggccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaa

SEQ ID NO: 5494 - DNA, 842 bp, Homo sapiens
gagaaggtaatgaatgtatgaaggtgatctggaaggacaatctatgaattggacaagtgaagaaggaagaggagacattataagaagtgggaccaacatagaccgagcctggcagtgccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagcc

SEQ ID NO: 5495 - DNA, 513 bp, Homo sapiens
tctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgagtctcactctgtcaccatgctggagtgtggtggtgcgatcttggctcactgcaacctctgcctcccagcaggggaaatgctgtctgtagctgagcacttcctggagcagcagatgcacccaacagtggtgatcagtgcttaccgcaaggcattggatgatatgatcagcaccctaaag

SEQ ID NO: 5496 - DNA, 593 bp, Homo sapiens
gagaattgcttcctgagaaggtaatgaatgtatgaaggtgatctggaaggacaatctatgaattggacaagtgaagaaggaagaggagacattataagaagtgggaccaacatagaccgagcctggcagtgccagaacacaaagcgtgaatccggaagaaaagttcaatctggaaacatcaatgctgccaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaa

SEQ ID NO: 5497 - DNA, 1858 bp, Homo sapiens
gtctggttctctctctccagaaggttctgccggttcccccagctctgggtacccggctctgcatcgcgtcgccatgatgggccatcgtccagtgctcgtgctcattaggtctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaacca

SEQ ID NO: 5498 - DNA, 2520 bp, Homo sapiens
gcgtaaaggttcccccggcgctcttcacccacagcgccccgggcgtacaatctcgccagcccggagcccaccgcacgcatcctcctcgcccggcgcgcagcggacagcctcctacgtcacgccagcgccgcgcggcaaggaaggcccccttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacatatatgtagcaaatcttacttaaacaaaagggtttcttaa

SEQ ID NO: 5499 - DNA, 2039 bp, Homo sapiens
gaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagaagcagcccagtggagggatccttatttctgtttttctgccgatgatcgccaacccggagtatggaggcctttggacttgccccattttgcatcttaatctcccttagtttttcatcctgcactgtgcatcattcatattggagccgaaagcagttcaaaatgccgaggattgcatgcagtcttcactagggatctgacgcttgagggctgtcgcttattgcttattggaactgcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtt

SEQ ID NO: 5500 - DNA, 1935 bp, Homo sapiens
cttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgctggtggagctgtctaaggctcaagatatagaagcaggagatggcaccacatcagtagtcatcattgctggctccctcttagattcttgtaccaagcttcttcagaaagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaag

SEQ ID NO: 5501 - DNA, 1619 bp, Homo sapiens
acacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaagcggttgctgatgctattagaacaagccttggaccaaaaggaatggataaaatgattcaagatggaaaaggtgatgtaaccattacaaatgatggtgctaccattctgaaacaaatgcaagtattacatccagcagccagaatgggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtggtttctcagtattcaagtctgctttctccaatgagtgtaaatgcagtgatgaaagtgattgacccagccacagccaccagtgtagatcttagagatattaaaatagttaagaagcttggtgggacaattgatgactgtgagttggtggaagggctggttctcacccaaaaagtgtcaaattctggcataaccagagttgaaaaggccaagattgggcttattcagttttgcttatctgctcccaaaacagacatggataatcaaatagtggtttctgactatgcccagatggaccgagtgctgcgagaagagagagcctatattttaaatttagtgaagcaaattaaaaaaacaggatgtaatgtccttctcatacagaaatctattctaagagatgctcttagtgatcttgcattacactttctgaataaaatgaagatcatggtgattaaggatattgaaagagaagacattgaattcatttgtaagacaattggaaccaagccagttgctcatattgaccaatttactgctgacatgctgggttctgctgagttagctgaggaggtcaatttaaatggttctggcaaactgctcaagattacaggctgtgccagccctggaaaaacagttacaattgttgttcgtggttctaacaaactggtgattgaagaagctgagcgctccattcatgatgccctatgtgttattcgttgtttagtgaagaagagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaagggtggtatttccaacattttggaggaactggttgtccagcctctgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttggtgttccttgtttggaagattatt

SEQ ID NO: 5502 - DNA, 3675 bp, Homo sapiens
aaaaaaaaaaaaaaccggaaatgggtcctaccatcttctcggagccggagtgcgaagaaataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttggggggaagtaattccggttgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaacaacctttatcttctcttcgggtttaagaaacgtttattgtaacagtaattaaatgctgccttaattgaaggggtttgggtggatttttttttctcaaaataagctgtagggactattttaacagcttaaacaggagctctcaagatgcactttcatattgagaggaatatgggcttgatcctcttcctatctaaatgggtgggccatttgattgtagagggtccaccacagaattatgggatgccttaagtgctgttactaggttgctcacagcctaacctggcgtgttgtttagggctgatggagacccatgtgagcctttgctttcctctggccccggccccaccctgaacacagctcatacacagaatcaggaccagcatgtgcagagctggccaccagcacaggcttagggcagttcagaacccacttgtttccctatcagagggacacagtgaagtggaggttaaagtaaattacaggaaataagggagaaatcttgcagttaccatgttcagatagagtgactgaaattaattgtacttactaaagtattaactagctaacagtgatgggccaagacgctccgagaactctaccgggattgtctgttctgacaacccagtgaggcagatacactttcttactgctcacatcttacaggtgagtactcataattggccagcatctcaccaccagcaagtagtagggccaggtcaatcccaggcagtctgaccccagagtggcccagctcatcccctactctgttatttgcttgttaatgattctctagattttctaaaataatgtttcttagcattgtgatgataaagctcatgatgaactttatcactagttatgccaccttaactagtcagatttcctagaattaggaaatggtgactcttgtctaaatttggttaagtgatgaatttgggttaccgtctcatgtgaacctggagattcaccagtcttaacttttgggtcattgtgttttctctacattcatgcattggatgttttgctaaataactcctgtggatttaggaatgtgtgctaatagcaatcttcctaattttcatgtttatatggaactatgcagttgagtattgaaagctttaaactgagtttatttacaaggactgagtctagcctacagagaacatacagcagccttctttggaccacagtcttatccgaggggtctgtggttgtatcagaagagccactaaaccaatccccctttccaaaattgaacctcacagacgttcctgttttttgtgattgagaaactggtcaatgaacaggaagacttagagatgtttcacaagcctttgatttttgtttcatttatttgtaataaacctcttccacgtgatgtcttttatttttcacgttcca

SEQ ID NO: 5503 - DNA, 1812 bp, Homo sapiens
attctcgcttccgtagcggtctccgccggttggggggaagtaattccggttgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggagatgtgactgtaactaatgatgaaattggagatggaaccacaggagtggttgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgta

SEQ ID NO: 5504 - DNA, 1933 bp, Homo sapiens
aaaaaaccggaaatgggtcctaccatcttctcggagccggagtgcgaagaaataaagaaatagtgctttaagtcaatgaattcctccttgggacccactatcgagaaactatcagtgtctcatataatggcagcaaaggctgtagcaaatacaatgagaacatcacttggaccaaatgggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaacaacctttatcttctcttcgggtttaagaaacgtttattgtaacagtaattaaatgctgccttaattg

SEQ ID NO: 5505 - DNA, 1939 bp, Homo sapiens
gtgctccccggaaaggtcgagaatctccgtctccctgcggtctccggccgctcagcccgcttactgagctcgggagacgccggcgcctaatcctgggctcggaatgtgggggccagccaggctgggccgccagcgcccttcggagctgggtggggccgctcagtccggtcgcccgcgggagcaaagcgggaccgcctccccgcccggctcctccagcctgacggccgcgtgggactgcgctccagtgggagggcgccggggagatgctctgtcacctgtcggttaaggcgctgctgcttaacctttcgctggtccacccgcaacggcccttccgttttctttgtcactcgtaaagtctcatataatggcagcaaaggctgtagcaaatacaatgagaacatcacttggaccaaatgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaac

SEQ ID NO: 5506 - DNA, 1728 bp, Homo sapiens
ataagtcccgcgcgtcttgtgctgcgcgtgcgcaagcttttgggccctcccgagaaagggaagtgcattctcgcttccgtagcggtctccgccggttggggggaagtaattccggttgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccat

SEQ ID NO: 5507 - DNA, 1997 bp, Homo sapiens
atgtgctccccggaaaggtcgagaatctccgtctccctgcggtctccggccgctcagcccgcttactgagctcgggagacgccggcgcctaatcctgggctcggaatgtgggggccagccaggctgggccgccagcgcccttcggagctgggtggggccgctcagtccggtcgcccgcgggagcaaagcgggaccgcctccccgcccggctcctccagcctgacggccgcgtgggactgcgctccagtgggagggcgccggggagatgctctgtcacctgtcggttaaggcgctgctgcttaacctttcgctggtccacccgcaacggcccttccgttttctttgtcactcgtaaagtctcatataatggcagcaaaggctgtagcaaatacaatgagaacatcacttggaccaaatgggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataat

SEQ ID NO: 5508 - DNA, 1814 bp, Homo sapiens
ggccgaggctcaagagagcgtggcgtcgcattgccgtttttgctcagaatcgcgactaaggctttttttttttctccctctgaacggttaggctatggctgcgataaaggccgtcaactccaaggctgaggtggcgcgggcccgggcagctttggctgtcaatatatgcgccgcccgagggctgcaggatgtgctgcggaccaacttgggtcctaaaggcaccatgaaaatgcttgtttctggtgcaggtgacatcaaactcaccaaagatggcaatgtgctgctcgatgagatgcaaattcaacatccaacagcttccttgatagcaaaagtagcaacagctcaggatgacgtcacaggagatggtactacttcaaatgttctaattattggagagttattaaaacaagctgacctgtacatttctgagggcctgcaccctagaataatagctgaaggatttgaagctgcaaagataaaagcacttgaagttttggaggaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaagttgatccaaggattagttttggatcatggtgcccgtcatccagatatgaagaagcgagtagaagatgcatttatccttatttgcaacgtttcactggaatatgaaaaaacagaggtgaactctggtttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaagactctctcttgcttgtggtggaatggccgtgaattcttttgaagatctcactgtagattgcttgggacatgctggtcttgtgtatgagtatacattaggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcttgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtcttttgggtctt

SEQ ID NO: 5509 - DNA, 1676 bp, Homo sapiens
aggctatggctgcgataaaggccgtcaactccaaggctgaggtggcgcgggcccgggcagctttggctgtcaatatatgcgccgcccgagggctgcaggatgtgctgcggaccaacttgggtcctaaaggcaccatgaaaatgcttgtttctggtgcaggtgacatcaaactcaccaaagatggcaatgtgctgctcgatgagatgcaaattcaacatccaacagcttccttgatagcaaaagtagcaacagctcaggatgacgtcacaggagatggtactacttcaaatgttctaattattggagagttattaaaacaagctgacctgtacatttctgagggcctgcaccctagaataatagctgaaggatttgaagctgcaaagataaaagcacttgaagttttggaggaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaaagaggtgaactctggtttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaagactctctcttgcttgtggtggaatggccgtgaattcttttgaagatctcactgtagattgcttgggacatgctggtcttgtgtatgagtatacattaggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcttgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtcttttgggtcttaatagtctcaaaaatatttcatcaaggtataaagaacacaataaatacttttacagtaaagg

SEQ ID NO: 5510 - DNA, 1627 bp, Homo sapiens
gctcagaatcgcgactaaggctttttttttttctccctctgaacggttaggctatggctgcgataaaggccgtcaactccaaggctgaggtggcgcgggcccgggcagctttggctgtcaatatatgcgccgcccgagggctgcaggatgtgctgcggaccaacttgggtcctaaaggcaccatgaaaatgcttgtttctggtgcaggtgacatcaaactcaccaaagatggcaatgtgctgctcgatgagatgggcctgcaccctagaataatagctgaaggatttgaagctgcaaagataaaagcacttgaagttttggaggaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaagttgatccaaggattagttttggatcatggtgcccgtcatccagatatgaagaagcgagtagaagatgcatttatccttatttgcaacgtttcactggaatatgaaaaaacagaggtgaactctggtttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaagactctctcttgcttgtggtggaatggccgtgaattcttttgaagatctcactgtagattgcttgggacatgctggtcttgtgtatgagtatacattaggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcttgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtc

SEQ ID NO: 5511 - DNA, 629 bp, Homo sapiens
atttaaattctgcagctcagagattcacacagaagtctggacacaattcagaagagccacccagaaggagacaacaatgtccctgctacccgtgccatacacagaggctgcctctttgtctactggttctactgtgacaatcaaagggcgaccacttgcctgtttcttgaatgaaccatatctgcaggtggatttccacactgagatgaaggaggaatcagacattgtcttccatttccaagtgtgctttggtcgtcgtgtggtcatgaacagccgtgagtatggggcctggaagcagcaggtggaatccaagaatatgccctttcaggatggccaagaatttgaactgagcatctcagtgctgccagataagtaccaggtaatggtcaatggccaatcctcttacacctttgaccatagaatcaagcctgaggctgtgaagatggtgcaagtgtggagagatatctccctgaccaaatttaatgtcagctatttaaagagataaccagacttcatgttgccaaggaatccctgtctctacgtgaacttgggattccaaagccagctaacagcatgatcttttctcacttcaatccttactcctgctcattaaaacttaatcaaacttc

SEQ ID NO: 5512 - DNA, 2332 bp, Homo sapiens
ccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcagcctggttctcccggaggacctttccttggggccctgcttcatgacgatgctgcctgtgtcaccctctaccatctgtaaacaactgggtgccttccccgaccacaccccaatgccttcccagcttggaagccaaggcagctgatgaagggagctcaggagagccgtcttcagctgggctggggttggggctgctgtgaggaaaacctgccattgtggccctggagagtcaccagcagctcttgggaaggacttgctgggaggctgagagaggctttgggcacagcctgctgtcttttccatttcctaaagtttacttcattgtcttgaggcttccaggttttgtttttgtttttgccaaagtagaaaaggcaggtggtgggcggctggcagggagtgcgggtccccgcccctcttcagtcctgccctcccctcctcagtcctgcccaccccgtgcagcccatgctgaggctgcagtggtgtcgtgggtgttacgtgcaggaacgtggagaccctgacgtgggctcactgcgtttggttttcttttcagaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgtaaataaacaaatggatccctgg

SEQ ID NO: 5513 - DNA, 2483 bp, Homo sapiens
agcgactcacaaaaggtcctcgcgccagcggcgtgcgtcaccatggcgaccgcgcgccgcgcagccgcgccccgcccctctggcgggaccggccaccatcctctcgcgagagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcagcctggttctcccggaggacctttccttggggccctgcttcatgacgatgctgcctgtgtcaccctctaccatctgtaaacaactgggtgccttccccgaccacaccccaatgccttcccagcttggaagccaaggcagctgatgaagggagctcaggagagccgtcttcagctgggctggggttggggctgctgtgaggaaaacctgccattgtggccctggagagtcaccagcagctcttgggaaggacttgctgggaggctgagagaggctttgggcacagcctgctgtcttttccatttcctaaagtttacttcattgtcttgaggcttccaggttttgtttttgtttttgccaaagtagaaaaggcaggtggtgggcggctggcagggagtgcgggtccccgcccctcttcagtcctgccctcccctcctcagtcctgcccaccccgtgcagcccatgctgaggctgcagtggtgtcgtgggtgttacgtgcaggaacgtggagaccctgacgtgggctcactgcgtttggttttcttttcagaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgtaaataaacaaatggatccctggaaacttt

SEQ ID NO: 5514 - DNA, 3010 bp, Homo sapiens
ggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccgaaaatgccatccgccagaagaaccaggcggtgaatttcttgagaatgagtgcgcgagtcgatgcagtggctgccagggtccagacggcggtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatactataccctagaaactctgaacacgccagaatgctgaaatgcccttctacctttgggtttacagccccctccacataaattaagaaattcagtatttctgcactcttagctggattctaaagttctgtatagctcgtaatgatggtatttttatagcagccttttaacagaactagttaatttcgtgtatatgaatctttctcgaagatctggtcaaaactgtattcagtttcctgcccagaatgatcagattgaaggtggttggtttttattattatttagtgtgattgatagtatctagaatggcaggtggtgcataaaagttaaagagaggggaaagattacttagtttggttatacagttataaacaccatgcagtgtattcggtggactgtgctatttctgtttatcctttgggttttggtttttgttttttttttttttgccttcacagtgagactgcaaatgattgttctcataacgtatattattaataaatgtggtcctataatttatactgaaattaccttaggatatttttgcataatactctcttactgcttacattctataaatttttcacgtgataattgtctttgcgtaactgggaaaaatgccgaataacttcctttattatctggaaaaattaaatttgttcatttatattttctacttactaaattgagtttttaaaaagacttagtgtgacatttgacagtgtctttcaaacgaacttctctaacaagtttatagttattttcctgtttcaacactattagaagtcttataaattatgctaattagcatggcagtcatgttacacactcttaacattgccaaagaactgttgatttcgtttgagaaaaccctaggactgtgtgtgtgtaggttttgttttgattttaacaaccaaaaatagaaataaaattagaactgcgttttaagttctaatttgcatttattaatttgtccaaaagcaagaactcttggaaatccttgaaaatataagctggaatgttttacttagccatgcaagtcatttatgtatacatccagccagctggaaatctgagaagtaaagaggtaggactggaaggaaggagaaagcttgagtctttaaggctagagcccagctgtgctgcctgccatcttctcaggaatggcagtgcgtattttctggctgaaaagtaaagcatgtatccaccgctttctcatagcctcgaaacatggagaaaagcaacttgcttttgccttggcaagcatgctaacctaagttaattcaagttttttttaacttaccctttccttcactggaagatttttccataagagaattccattgtttcagaaaataattataggggcccttccaagttctttgaaagattcataaccaactattcactattataacatgtttcccagtgtaaatgagtaaggaaaaaaaaagtgtaacaggtgcgtgcagatgaggagtgaccctcatatttaagttattttatatttgactggacattgttcagaagtgtgctttaagggacacttgttagttgtctgcccagcatctctcaagaatatccctcctgtcctccacatggttgtgcagggccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcccaaagtgctgggattacaggcatgagccactgcacctggccttaacccctctttagattggaaaaaataattacaactttaaaaatagcttagtgttgaaccctttggtaaactaaagacccttttataatgcacatattcccaacaaaattaatatattttgtgagattaaacaatgcttgtatatgcttgaactttcttaaaatatgtccatgtcatactattatgaatgtacatttttatgagtcataaatattattttcaaaagcactacaggcccatgaattacttcctcacttttgcagttgattactgaaatgtaaatcacaagaatttgtcaattaaatcattttaaactgcatgtta

SEQ ID NO: 5515 - DNA, 907 bp, Homo sapiens
acgtcacgtcgtttaatccggaaacggcggcggcggcgacaggaccgaggggccttagttggtgggcaagtcggggatcccagaaagagaagcgtgacccggaagcggaaacgggtgtccgtcccagctccggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacact

SEQ ID NO: 5516 - DNA, 885 bp, Homo sapiens
ctggaccgtggatcccgggcgggcgtgcgggcggcagcgtacgaggccttctactcgcccgggtgtccggtgcctcgcttctccctgggaccctgtcgtcaacatcgaggcctgccagtgagcttctaccatcatggacctattgttcgggcgccggaagacgccagaggagctactgcggcagaaccagagggccctgaaccgtgccatgcgggagctggaccgcgagcgacagaaactagagacccaggagaagaaaatcattgcagacattaagaagatggccaagcaaggccagatggatgctgttcgcatcatggcaaaagacttggtgcgcacccggcgctatgtgcgcaagtttgtattgatgcgggccaacatccaggctgtgtccctcaagatccagacactcaagtccaacaactcgatggcacaagccatgaagggtgtcaccaaggccatgggcaccatgaacagacagctgaagttgccccagatccagaagatcatgatggagtttgagcggcaggcagagatcatggatatgaaggaggagatgatgaatgatgccattgatgatgccatgggtgatgaggaagatgaagaggagagtgatgctgtggtgtcccaggttctggatgagctgggacttagcctaacagatgagctgtcgaacctcccctcaactgggggctcgcttagtgtggctgctggtgggaaaaaagcagaggccgcagcctcagccctagctgatgctgatgcagacctggaggaacggcttaagaacctgcggagggactgagtgcccctgccactccgagataaccagtggatgcccaggatcttttaccacaacccctctgtaataaaagagatttgacacta

SEQ ID NO: 5517 - DNA, 2606 bp, Homo sapiens
agaagtgacttctccaaaaagtgtgttagttcccggtcacctgagctccgggtgacgcggctgcggtagctgcggatacaagccttccgcgggtcctgcctggcgaccccgacctcctcctgctgtctctccgctccgccaccccgaacccgccaaggtcctgtccttttcctcctgtcctttgccagcgttgggccggaccgggccgagccgggccgcccgggcgcagtctttaaccatggcgtccctcttcaagaagaaaaccgtggatgatgtaataaaggaacagaatcgagagttacgaggtacacagagggctataatcagagatcgagcagctttagagaaacaagaaaaacagctggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctactacagcaaaaacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaatgaagaccatgagtgaacagttgtttcctaacccatggctatttagaatcttttgccaaagaatgacaatgatgcaaaaatgggaacagtttggattttaattagaactgtttaggagtgatgatgtgtaaaaagttgacttctcttttgcatggcacagagaaattatattccttacttcatgtcagtttatgttctaaatctttttcactgaatataaaaatcttgttaaatgccattaggcaccaacttaaagagggttgtaaaaatattaaaagtatatcgttaattctgtatctgttgcttgtcttttgtaagtgattatgtgttatgaccataggtggttacagctgccaaattatttttaaatggtcaaaaagaagagtgctatttaaacatctgtcttaaacaaaaactgtcataacttttcttttttctttttccattaggagaacattctagttggtaaatttcaaaatgtgcttgacacctgccttaaatagcacagacctattgtgcacatctttaaattatttcagctggcagaaaagaattacatttaaaactgaaatcaaggcctcaatacaaagattatcctggctcttttctatctctgtgggcctaattgaaatatgtactcttattttagacacgcctctgttaaaacagaccaggttttcctggtctcagacctatgatgacttgtccctttgatgtcactactgtgaattgaatataattagtaaaaatagacgatgaataaataacactttatagtaagaaaacaatatattttggccatctaaaaatgagaattataattatatgaattataatttaaactgtttaattttgtttaatgtgtatattgaatcttccaaattgaagccattattctcaattaagtactacaactatgacaatgcttgacctacatttctaaaataaaaattcacattttttgataaataaactacagttttaccagaaattactatctaaatgtgtattagcagtattttttaaggtgaaattgccttggtatctaatgaatgtgtagacagggagataaaatgaaggattgccagactagttagaatagaatttaggattaggttagttttgaaaaatgatgttgtaatatatgggttctaacacatcctaccataaaaactggaggagatatgtgtaacctggttaatttgggatggtggacattttgggctaatactgacaaaatacatcttaggactagtatacatgtgacacggattgctaggaggaatgaaaaactaaactgtatagtttatattccgtaaaccattttataatgttcaaagattaggttttgttattgatagtattaaatacacagtttctcttaacagtgatgggtgaaaacattttaccggattatggaatgtttaccagaacatgttttgattcttgaatgtacataataatgccatctaacttatttacgttcttgtttacatgtgggagcttttgttttcaaaaattattttgttaaaaaatctcaataaagatttattattgttgttcttttcttaccttttttgctctttttggttcctgctaaaattaaaaattttatgcata

SEQ ID NO: 5518 - DNA, 894 bp, Homo sapiens
cgcaggcgccgcctagaagtgacttctccaaaaagtgtgttagttcccggtcacctgagctccgggtgacgcggctgcggtagctgcggatacaagccttccgcgggtcctgcctggcgaccccgacctcctcctgctgtctctccgctccgccaccccgaacccgccaaggtcctgtccttttcctcctgtcctttgccagcgttgggccggaccgggccgagccgggccgcccgggcgcagtctttaaccatggcgtccctcttcaagaagaaaaccgtggatggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctactacagcaaaaacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgc

SEQ ID NO: 5519 - DNA, 3171 bp, Homo sapiens
tgccgccgctccctactctgggggttgggactacctccttttccgcgggccccgcccaggcggctgcccgtgacctgcctgggcgcggggaactgaaagccggaaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggaccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcat

SEQ ID NO: 5520 - DNA, 1099 bp, Homo sapiens
agtgccgccgctccctactctgggggttgggactacctccttttccgcgggccccgcccaggcggctgcccgtgacctgcctgggcgcggggaactgaaagccggaaggggcaagacgggttcagttcgtcatggggctgtttggaaagacccaggagaagccgcccaaagaactgatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttgg

SEQ ID NO: 5521 - DNA, 1135 bp, Homo sapiens
actcgggggtcggcagtttgcaggtgcgatgggcggccccctcacccacgtttatccggactggagcccgccgctcccggctgggtttccgggtggttcgcgctccttctgaattggcagcgaggtcgcggcaggttcgaggctttgacaccagcacctctctatgaagaaaagagtgtgttgtgaacgaagtcagaatttcctgtgttccctttgccgctcctggagttcactggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccag

SEQ ID NO: 5522 - DNA, 1851 bp, Homo sapiens
aaggggcaagacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctcc

SEQ ID NO: 5523 - DNA, 1393 bp, Homo sapiens
atgtgagacattagactgcatcaggtttgccatctaaacttagggcaaccccaagtgcttgaacctataccaccccactttcctgagctctgtaaagagcatgaagttttcccactgaccccatacactgaggtgccatcacactgcacatttccttccggagaacaagcacgtactcaggtggagatagaactgtctttttacttaatagaaaatgatgtggcagctttaagaggagcgcgtcggtctggggctggtggcttgggtcacgtgacaccggtggtctcgtttgcgcctcttgatgtcgcggcggcgccctgaggacggattgggcaaggctggtccctgtgtgatgagacatcaccctcccaggagcaaggcggaagtctggaggacgctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactgggcagatggaatcctagtgtctatactgccttgtctacccctg

SEQ ID NO: 5524 - DNA, 1646 bp, Homo sapiens
ggtggcgcggccgggcccagctgcggggcggaggcggaggcggaggagaggcctgcggcggcagggagcggcgggactgggagcgggcgccggagccgacccgagccgagccgagccgagccgagccggagcgggcggcgaaggccggcgcggcgagcagcaaccatgtcggtgttcgggaagctgttcggggctggagggggtaaggccggcaagggcggcccgaccccccaggaggccatccagcggctgcgggacacggaagagatgttaagcaagaaacaggagttcctggagaagaaaatcgagcaggagctgacggccgccaagaagcacggcaccaaaaacaagcgcgcggccctccaggcactgaagcgtaagaagaggtatgagaagcagctggcgcagatcgacggcacattatcaaccatcgagttccagcgggaggccctggagaatgccaacaccaacaccgaggtgctcaagaacatgggctatgccgccaaggccatgaaggcggcccatgacaacatggacatcgataaagttgatgagttaatgcaggacattgctgaccagcaagaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttcata

SEQ ID NO: 5525 - DNA, 1465 bp, Homo sapiens
aatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaaggatataattttaataa

SEQ ID NO: 5526 - DNA, 1707 bp, Homo sapiens
gttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaaggatataattttaataatatcacttcagcttaaaacctctactgcggaaaccaaatttaatagaattttaatgtcatttcagcctataactccactacagaaaccaaattaaccagtagcattgtgaggaaagagcaaggaacaatctgggcttgggccctgggtctaccatttactaactactgagtagtctattcaacctctctaaccttctgtttccttattagtaaaatcatgcttaactcacagagcttttgtgaggaataattgaggtaatggtcataagtaccttgttaactgcaaggggctattcttatatgagggattgttaacaataaaaaagaaactgcttcattcttttcttggaaggtgcctggagtactacagcaagttcaaactcctgcccaatttcagggtctttaatgatcctgtcctcccttcctcattcaacttgttgccaacagcatgg

SEQ ID NO: 5527 - DNA, 1663 bp, Homo sapiens
aggacccgagctacggtggccgcggggcggcggtggcgattggacttggtgggtcccgggccaggggcgggcgccgccatgggtaacctgttcggccgcaagaagcagagccgcgtcacggagcaggacaaggccatcctgcaactgaagcagcagcgggacaagctgaggcagtaccagaagaggatcgcccagcagctggagcgcgagcgcgccctggcccggcagctgctgcgggacggcaggaaggaacgggccaagctgctgctcaagaagaagcgataccaggagcagctcctggacaggacggagaaccagatcagcagcctggaggccatggttcagagtattgagttcacccagatcgaaatgaaagtgatggaggggctgcagtttggaaatgagtgtctgaacaagatgcaccaggtgatgtccattgaagaggtggagaggatcctggacgagacgcaggaggccgtggagtaccagcggcaaatagacgagctcctggcaggaagcttcactcaggaggatgaagacgccatcctggaggagctgagcgcaatcactcaggaacaaatagagctgccagaggttccctccgagccccttcctgagaagatcccagaaaacgtccctgtcaaggccaggcccaggcaggcggagctggtggcagcttcgtaacgtggcctcgtcttgtgggactcacggggatgccccagggactgtggcccacagagagtttgggtcacggccagcccctgaccgggttccctggagcccagtgcgcacggtgctgagcagagctgcagccacgcaggcgcattgcaggaggactccagagcgtctcctggagaccttgagcctgaacgcactcaggcgccactggcctgctctcagtccggattaactctcgaccgagcccagcttctgccggttgtgggctcccccggtggccgaggcccaggcccaacgcctctggtgctgttcccctgcagtcccagccccgcgtggctcgcgctcgtctgtgaggaagacacctccagaccttggggtccccgcgcttcctcttgctcctcgctgctcccattagctggtgcaggcttccgttaaggggtccctcccttggcctggcttcccggcgcacctcagcttccctgctggtggggggatccccaggagaccagcatgtgctgaacctctctgtgcctctgcctccgcaccctagacacccacctccagtttgaaggtggcgggccaggggctttcttgctgaattgacgactccgagagccctgactcccgccttgccactcacggctctgtccactagggctcagccctgctgagaaaggacctccgatgcttgggagacgctgctccggcaggtgcagccccggaagtttgtccatgggggtccccgcggctggggctcatggaactgcgagacccgggaccctcctgccctgcgggtccccgagccaccagcagccaggactggaggctgtggggcatggcgtgacttctcgtgcacagggctggtttggttatgagacgatctcgctgggaccgcccctgcccgtggaaagccacaaggacaaagggagcggccacctcgacccccagacaggccggcccgtattaaagttggccctgcacgccc

SEQ ID NO: 5528 - DNA, 2814 bp, Homo sapiens
agcggaccagggccaggcttgtgttcgcagccttgccggggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcgtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcttgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccgaacactt

SEQ ID NO: 5529 - DNA, 3403 bp, Homo sapiens
gctgcctcctctgactgttatgcagcaggccggcaggtcaataaacttgcttgcctgactttgagtatactcgtcttttctcttggccaaccttacggtagctgtaccagtttgcatttccaccagcaatgaatgagagttcctgttgctctgcatcctcaccagcatttggtgtggtcagtattttggattttcaccattctaatagagattcacggatccatccgggtggtccgggcaccactggcgcccctctgcggctattccccagttccattttctgaagccacaggtcagaagccgctgtacaacgctttgccgaactccagaatcttgaaggagacgtaaggtgcagccacctgccgcgcaggcgcaagcctttctttcggcacaaagaccgtgggaggaggggtcggcgcaagcgctcggtgtctctctgaaaagaacttcatcatactgcctcctggctgacggagcgcagcgcaacgcatgcgccttgaagacttatggaacttatttcacgctcagggcggcggtgacgtgtgaacgagaaggaggtggtcaaggaacggaagccgggagggaacgagggcggaagcggaccagggccaggcttgtgttcgcagccttgccggggctggggttccgatgtggtccccggagcgggaggccgaggccccagccgggggagacccggcgggccttctgccccccgagtgggaggaggacgaggagcgcatgtccttcctgttctccgctttcaagaggagtcgcgaggtgaacagcaccgactgggacagcaagatgggcttctgggcgccgttggtgctgagccacagccgccgccagggggtggtgcgcctgcgtctgcgggacttgcaggaggcctttcagcgcaaggggagcgtcccgctggggctggccacggtgctgcaggacctgctgcgtcgaggggagctgcagcgggagtcagacttcatggccagtgtagacagcagctggatctcctggggggttggggtcttcctgctgaagcctctcaagtggactctttctaacatgctgggagataataaggttccagctgaggaggtccttgtcgctgtggagctgttgaaggaaaaggctgaggaggtgtatcgtctgtatcagaactcgcccctctcctcccaccccgtggtggccctgtcagagctcagcaccctctgtgctaactcctgcccagatgagaggaccttctacttggtgttgctgcagctgcagaaggagaagagggtcacagtcctcgagcagaacggggagaagattgtgaagtttgcccgagggccacgtgccaaggtctctccagtcaatgacgtagatgttggggtgtaccagctgatgcagagtgaacagcttctctcacgcaaagtggagtccttatcccaggaagcagagaggtgtaaagaagaagcccgccgggcatgccgagcaggaaagaagcagctggcactgaggtctctcaaggccaagcaacggacagagaagcgcatcgaggccttgcatgccaagctggacactgttcaaggcatcctggaccggatctatgcctcccagacagatcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcttgctgggtgtgtacatagttatttaaacaagaaactctcagaatgtgtttggaagaggagaaaggagaaccactgattttatctggatgctactacttactacaggacagatagaatttctggaagcgatgctccaaaggcttgctcccagctgtatcatggacctgccttctcatctttatagtgccacgatttatacagtcctgtgtctgacctgtcatttcatagcctgcagttcttgccattggcacacttagatttgtcttcacccaccagcttcgttccagcccatgaaggggaaagatttgcagctttgccaaatctgaatcagttcccactcccccctgcggttttttagaggggtttatcctgtcgctaatgtcagttaaatagcttattcctgtcccacttgatttcactggtaagaatgagaatgaaatacttaaaggttttatttgaggggacttagctgccattttatggaaaaacatgtagtataaaaggtttttctccagggtcatttgacagaattctccaggtgttcagagaaagaggtcgccccaagtggcccagagtcgtgacagtccggaggggctggtgtggccggtgggcgctgcctcttcatctgatggagccaggaggtccgccggtgggggaaaggcttcttccgaggcttctgcactcgcctgggaagaggcccagtcactacaggaccctgagatgtccagaccccttatgcaaagaggcaaaattgttgccttggccccatcatggagtaacttaaaaatacatatctatcttccagaacaagccacacaacaacacacctcccctccttgagcctggcacacagcaccgggctctctgaatttggaaagtgtttcattttgtggcctactgctcggggcaggggggctgagccaggatgtgcaatagaagcaggggttgtcccctctgccagatctgtggggagctgcccaggccacccgtgcacctgtcctgcttcctgcagtccccactccctgcctcctttgagggactgggggacttggggtagggggacagacgggaaagggtctgaatgctctggcaatggcgagaagaagcgatcgccacactgccactctgctgcccagccaccaggatttctgcctggagccctttgccctgtccctgctgcctgaggtggcgtagagcagaggagaagaatttgctccaggccaggagcacaaatcgttgttcaatgaatttctctccaactcgaccttggtaaacggaaatgttgggggtgaagagaaacaatcactatttttttcttttttatctggtaaataattaaaagaaaaaccg

SEQ ID NO: 5530 - DNA, 3258 bp, Homo sapiens
ctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgaagctaacaaggaaaatgtgttccatgggaccaaagatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccaggcaatagtcgcagtgaagaagatgtgcaaagtatggatgccagaaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgtttttaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccgcggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctc

SEQ ID NO: 5531 - DNA, 3139 bp, Homo sapiens
ctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgagatggtgccttgctgtgttgcccaggctggtctaaaactcctgggatcaagtgatcctcccaccttggcctcccaaagtattgtgattacagggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccagaaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgtttttaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccgcggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctcc

SEQ ID NO: 5532 - DNA, 2648 bp, Homo sapiens
gccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgaagctaacaaggaaaatgtgttccatgggaccaaagatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccagaaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgtttttaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaa

SEQ ID NO: 5533 - DNA, 3250 bp, Homo sapiens
ggatcagctgagggagccgcaatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccagaaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgtttttaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccgcggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctc

SEQ ID NO: 5534 - DNA, 875 bp, Homo sapiens
cgagggggctgcggcgggcggcgaagggggacctggttgcggccgtgggagggggcgcccgccggcgtccaggccgggctgcggggctgcgtgggcgcgggcggccgggccggggcccgcggggtggggcgggcgccgagtctcggcctctggggtcgggagtctccatgggcgtttccggggtctccgcagatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgatacctcaggtgcaggtgcagggcgaggggccgatccccgggtccctccgtcgtcgcccgccactcaggtgtgctttgaggaaccacagccatcaacatcgacgtcagacctcttccccacagcctcggcctcttccacggagccttctcctgcagggcgagagcgttcctccagttgtgggtctgggggtggtggcatctcccctaaaggaagtggtccctctgtggcaagtgatgaagtctccagctttgcctcagctctcccaga

SEQ ID NO: 5535 - DNA, 2446 bp, Homo sapiens
agaatgctgatattcaggccaggcacggtggctcatgcctgtaatcccagcagtttgggaggccaaaacaggaggatctcttgaccctgttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaacgtggcatacctctatgaatctttaagtgaaaagcaaggcatgacacaagaatcctttgggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccagaaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgtgtcgggcagacagtgctttcctgcgacatcattataaacaggtaacattgccccttcatctcggcagagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgtttttaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttc

SEQ ID NO: 5536 - DNA, 2990 bp, Homo sapiens
aatgtctcttgacagcggcggcggcgcagccggttccgggttcggcgcggggcggggatgtgaatcccgatggagcggcccgaggaaggcaagcagtcgccgccgccgcagccctggggacggctcctgcgtctgggcgcggaggagggcgagccgcacgtcctcctgaggaagcgggagtggaccatcgggcggagacgaggttgcgacctttccttccccagcaataaactggtctctggagatcactgtagaattgtagtggatgaaaaatcaggtcaggtgacactggaagataccagcaccagtggaacagtgattaacaagctgaaggttgttaagaagcagacatgccctttacagactggggatgtcatctacttggtgtacaggaagaatgaaccggaacacaggtctgggggtggtggcatctcccctaaaggaagtggtccctctgtggcaagtgatgaagtctccagctttgcctcagctctcccagacagaaagactgcgtccttttcgtcgttggaaccccaggatcaggaggatttggagcccgtgaagaagaaaatgagaggagatggggaccttgacctgaacgggcagttgttggtcgcacaaccgcgtagaaatgcccaaaccgtccacgaggacgtcagagcagcggctgggaagccagacaagatggaggagacgctgacatgcatcatctgccaggacctgctgcacgactgcgtgagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccagacaagagtcgcagtgaagaagatgtgcaaagtatggatgccagaaataaaatcactcaagacatgctgcagcccaaagtcaggcggtctttttctgatgaagaagggagttcagaggacctgctggagctgtcagacgttgacagtgagtcctcagacattagccagccatacgtcgtgtgccggcagtgtcctgagtacagaaggcaggcggcgcagcctccccactgcccagcacccgagggcgagccaggagccccacaggccctgggggatgcaccctccacgtccgtcagcctgacgacagcagtccaggattacgtgtgccctctgcaaggaagccacgccctgtgcacctgctgcttccagcccatgcccgaccggagagcggagcgcgagcaggacccgcgtgtcgcccctcagcagtgtgcggtctgcctgcagcctttctgccacctgtactggggctgcacccggaccggctgctacggctgcctggccccgttttgtgagctcaacctgggtgacaagtgtctggacggcgtgctgaacaacaacagctacgagtcagacatcctgaagaattacctggcaaccagaggtttgacatggaaaaacatgttgaccgagagcctcgtggctctccagcggggagtgtttctgctgtctgattacagagtcacgggagacaccgttctgtgttactgctgtggcctgcgcagcttccgtgagctgacctatcagtatcggcagaacattcctgcttccgagttgccagtggccgtaacatcccgtcctgactgctactggggccgtaactgccgcactcaggtgaaagctcaccacgccatgaaattcaatcatatctgtgaacagacaaggttcaaaaactaagcatccagaggccctgagcagctttcagcactggaggtgaagagagcgtgtttttaaaatacagagacaagcacgtcaaggtgttttcacagccccctgagggaagggacgcagggtctccgacaggtgctctggggtgactcttctgtggagctttaccctctgagtgagaccctccccagagccccgggggccgcagcccgccctcctggtgagcgctgggcagggctcgtggtggcatcagcagcagagacgaagcctttctgtaacatgcggccgtcccgccgagaggggcagttttgctcttttgtacattttccgaaactacagttaaagcagaagtctgtttttaggaaaagtttcaagggagaagggcaagtttatcaaaaacattgtttcaggagaagggagcataagtttacagcctacaggacgtacacaatatcctgctgctgggaaaaccacagcattttatctattttttattttaataggtttggtgcttatcttctaataagatttaaatgtcacaaactgtagcacaaataatataatttataatttacaaattgactaaaattgggtatagtatggtatttgaaagaataagcatatgcttctgtttattaaaaaaagaaaccttccaatgtccaaaactgctaaccctcgacgtggccgccaagttagtcgctccttgctaaccggtgagtgaccgcggccccgagcctggggctggacgcaggtcccaggacatgctgctcccttgtgtgagtgaccgcggccccgagcctggggctggacgcaggtcccaggacgtgctgctcccttgtgtgagtgaccacggccccaagcccagggctggaggcaggtcccaggacgcgccgctccctcatgctgcccgggcccttcctccaagaccctacagagcctgaggggcaccttggcttccgcctgtgctagctttgccatgtcatctggaataatacttgaaattttgatttttggaaaaaaaagttttttatcttttgttgaaatcacctgttatccttgtttgtaaactgataacttttttgcttcttctcaggaatacagttttcaactgttgtcttgctcttgatagaaactgagaagcagcaatctgtatttgtggaggaaagtcctctcttttgcatattctaataaatgagccgcgtttgctcctc

SEQ ID NO: 5537 - DNA, 1367 bp, Homo sapiens
taagaaaaataaaagcatcagtattgcaaagactttccatgatcctacacccacctcgaaagccccctctcaccacaggaagtgcactgaccactggaggcataaaagaggtcctcaaagagcccgatcctcactctccttgcacagctcagcaggacctcagccatgagacttctcatcctggccctccttggcatctgctctctcactgcatacattgtggaaggtgtagggagtgaagtctcagataagaggacctgtgtgagcctcactacccagcgactgccggttagcagaatcaagacctacaccatcacggaaggctccttgagagcagtaatttttattaccaaacgtggcctaaaagtctgtgctgatccacaagccacatgggtgagagacgtggtcaggagcatggacaggaaatccaacaccagaaataacatgatccagaccaagccaacaggaacccagcaatcgaccaatacagctgtgactctgactggctagtagtctctggcaccctgtccgtctccagccagccagctcatttcactttacacgctcatggactgagtttatactcaccttttatgaaagcactgcatgaataaaattattcctttgtatttttacttttaaatgtcttctgtattcacttatatgttctaattaataaattatttattattaagaatagttccctagtctattcattatatttagggaaaggtagtgtatcattgttgtttgatttctgaccttgtacctctctttgatggtaaccataatggaagagattctggctagtgtctatcagaggtgaaagctatatcaatctctcttagagtccagcttgtaatggttctttacacatcagtcacaagttacagctgtgacaatggcaacaatttgagatgtatttcaacttgtctctataatagaattctgtttatagaataagggagaaaataatccagtcttcactgggttcccattctgagggtccactactcaaaaatttgcttcactcaatttttttcacctctttgtgttttattttggtgtcctattaaaggaataaaatgacacaacttgtcccttttttgtcccattagcaaaaattagaattttggtataaagaaactttattcaagtaaaaatcaataccctttgaattggacaataatctcactaccttattaggatttctgtatttgccattacgctagttatcatgcatgttatgctttactgcgaataagcttttaatgctccaaatgctgacccatgcaatatttcctcatgtgatcacaatttgcagtaaacttttaattaaatgctcatctggtaactcaacaccccag

SEQ ID NO: 5538 - DNA, 565 bp, Homo sapiens
actctccctgcacagctcagcgggacctcagccatgagacttctcatcctggccctccttggcatctgctctctcactgcatacattgtggaaggtgtagggagtgaagtctcacataggaggacctgtgtgagcctcactacccagcgactgccagttagcagaatcaagacctacaccatcacggaaggctccttgagagcagtaatttttattaccaaacgtggcctaaaagtctgtgctgatccacaagccacgtgggtgagagacgtggtcaggagcatggacaggaaatccaacaccagaaataacatgatccagaccaagccaacaggaacccagcaatcgaccaatacagctgtgaccctgactggctagtagtctctggcaccctgtccgtctccagccagccagctcatttcactttacaccctcatggactgagattatactcaccttttatgaaagcactgcatgaataaaattattcctttgtatttttacttttaaatgtcttctgtattcacttatatgttctaattaataaattatttattattaagaa

SEQ ID NO: 5539 - DNA, 5281 bp, Homo sapiens
gttcatctggattcatggagtaggcgtttctattcaaacatgcaggctcttttctttatccagggcttgcagcttgattttcaggctgttcttggtttgaaggagttccaccaaggatccaccctaactgcctgcctgactggcttcttccttcctcctctctcactagctgtccccctctggccccctggctctctctgagactcctcccatcctcctcctccagccttctgggcaggacaggtgtttcagtttctttaagtgaaatatgaaacagagaagcaccatttctgcctcaagacgcatgtaaagaggtgtagattcagatgctctaaacgtccctgccatctggtccagatggagtcctcaggcaacccagagagcaccacctttttttactatgaccttcagagccagccgtgtgagaaccaggcctgggtctttgctaccctcgccaccactgtcctatactgcctggtgtttctcctcagcctagtgggcaacagcctggtcctgtgggtcctggtgaagtatgagagcctggagtccctcaccaacatcttcatcctcaacctgtgcctctcagacctggtgttcgcctgcttgttgcctgtgtggatctccccataccactggggctgggtgctgggagacttcctctgcaaactcctcaatatgatcttctccatcagcctctacagcagcatcttcttcctgaccatcatgaccatccaccgctacctgtcggtagtgagccccctctccaccctgcgcgtccccaccctccgctgccgggtgctggtgaccatggctgtgtgggtagccagcatcctgtcctccatcctcgacaccatcttccacaaggtgctttcttcgggctgtgattattccgaactcacgtggtacctcacctccgtctaccagcacaacctcttcttcctgctgtccctggggattatcctgttctgctacgtggagatcctcaggaccctgttccgctcacgctccaagcggcgccaccgcacggtcaagctcatcttcgccatcgtggtggcctacttcctcagctggggtccctacaacttcaccctgtttctgcagacgctgtttcggacccagatcatccggagctgcgaggccaaacagcagctagaatacgccctgctcatctgccgcaacctcgccttctcccactgctgctttaacccggtgctctatgtcttcgtgggggtcaagttccgcacacacctgaaacatgttctccggcagttctggttctgccggctgcaggcacccagcccagcctcgatcccccactcccctggtgccttcgcctatgagggcgcctccttctactgaggggcctgtggcggtgcaggcgcaggtgcaggtggacagggactggaatgggggtcatggagaagcgggcctggaaggagcattgcagaacacagcagggtggagacgtctcctccgctgcaggcgtgcagtgaaggtcattcattacaccagtgggtcccgccagcctctcatctgcgggaaagtggcttcctacctgggaattttatactgccatccaaaaaaacatttcttgaactctgagttcatcttgcacgctccttcatttagacatgtgtttctaatcactgtttagttcagaaggttctaagacatgaaaggattctgggaaaggtgcttccttggagactttacagggcctaaagctcattgtgataactgcacgatgctgacaagacaatgcctcccttccctgactgtaaggttgtccctactggtttattcactttggaggcgcctggctccgtattcctcaggtactgctggatgaggctgtctggaagacaaaagtcgccataccctgagataagcagtcatgttgatatctggattctaaaaatccacaactagactggagaaatgttctgtatcctggattcaagtcctagcccacgaactggcccttaaaaatttagctcataaatatttgattgaaggaatgaatttaataagtgctaccttctgcactaagtatttattcagagaatacaaagatgaatgagatacagttgctaccctccaggggccaacagcccagctccaaaggctcacctaccttggtgaacacccaccttggtgaaggcatctagggtggactcctccgacatctcatccttcccaggtggatagtgagctgacttcacatttatcactttgtacctaaagtgtcctcctcctatttggttgatggtggtagctccccccacccacccacactccaaacctcaagtcctcttggaggcctgtgttttcttttcctcaactcccacagccaggtccaaatgactatgcctgtctagtggctttcagagttgactcattcttgccattgcatgcccatggtttcatccctgaaacagggcctcacttccttggcatctccccactgctcctctctttccccaccaggctgttctctgcccttacaccaggtgcttcaaaacccttagtggctcctcattacttacaaatgaagtccatacactttagcaaggctttcaaggcctccacaatccgatgccagccaacttttccattcttattccactctaagcctcctccccacagcagcttgggatccaaccccaaaacaccactggccttctttcagacacatatctccccagtaccctacctctaggcatttgtcatgctgtcacctgggcctggaacatgttctagctgacaggccagcttctccaggaagccctccctaatctgcaaattagaacattctctgggttgtcgtgggattctgcttgtcccctctaaaataaaacaaccttgtgttgtagttacacacatgcaatgtcttatctccctgccccatcaggctgcaagcttcttgagggcaggaacctggtcttgaaccccagtgttctatcactgtgtgctcagtgggagcaaagaatcaacagctgttattatccttcagatttatgcttcttggggagccatgccctggggcacactttaccttctttgtcccaggctgcttctctataaatattaacctttctttcctagtctacactctcagagagtagtagaaagagagtagggtgtagtagtagagagattgcttatctctctctgtggcgatggctatgcttcaccttgccttctagttcatggtacgcatccctgcctctcacactggcccattgcttcacacccaagggcataaataaaagccactctctaaactttgccatgccacaaagacctgggcccaatctgtgaacctgatttggctctggcgtggggatttggaaaagcttcccatgcgattctgacatgcaccttcattaggtacatttggctgcaacttttttaaaaaatgaggagtccagagtcttctacagtcccttgagcagggatttgcacacagaagacactcaatatcttgttattgaataaagtagataccaatgtagccctctggccaacctagagagagcttgtaaggcatttccccttcagttccagatgcaacttcaatgatctatttgccaatggggcagtagatctggaggagtttatcggtctagggaagagccagggcctagttttaataatgaggccagtagcacctgctggacagggctgggcggcataccagtgaagggaaggggctcccatggacctacctgccagcctacaggtggggccactactcaccaccgatgggagaaacagcataaggaagagataatgaggtagtttgtggtatcagagctaagcctatgggcttctagttggcctaatctttcaaacacagtttcacactgattcttaacattttgttcaacttttactcagagggcaggctgagccagggagcaaaaaggcaaaggactcctactcacatacccacttagcaaaaccaaagcaccttgggctttgaacccacccttcttagaaggcaggtttgggggttgaggccccttgagaagctcacttcaccctctccccatgccatcccattcctacccatcccaagatgcttctcttgtatttctttcagcacatccagccatctccctgggagcgtttcatatctgactctttatacttccagtgatgttttggcatccctaatagactggctcccaaggcagtctttaatcaggagtcttcccctaatctagctcctcaagaacccaagggaagaggcacaaagagaagtatgaataggaagatagaagggtaacccagtcagagagggagtggcagatgacactgctgaaaaggagtttccagagagttgcacaccatgagccacgctgtctgtccctgaccacaacctccactggccaccacctcctgggcttcccctccctccacccacagaaaccattgctcaatctcaactggactcttgcaggcctatctctccctccaaacagagatgtcctggacacagagctgcagacctctaaccactcctggaacataaaaaaacccacggtggttctacagcatttacacctccagtttccctcagacagaatccagaagagaagaacctcgctgatctctgagcggagcatgtctccaagctcaggccagccccagaactccaatggcctcaactggagtggaaatccctcaaaggcacaaacccagttcctaccatctccctcagtgcctggcaatgtttgtggttggttgagtgagttaacaggagaccatcttttggccttttttctacctctgttttctcttactatacttgcctacatctcatcttctggtcaacaccaggtactcaccccatgagcttcttgtgaacttgtctggggcccaccggcctaaacatcatcttttttgtttggaattaagctttgttgaacttttcacaggtttcatttatgcaaatgcctgtgatgggacaaaaaggtctgcaaacatggaaacctggtctaaagatgtccaaagtaaactgtctgtggagtcgaatgacatttgagccctggacctaaactccaaatccaagctctttcccactgtgaccttgggcctctcaaggctcagtttcctcacctataaactgtagagaagccaataacagactcatccacactatgaggctgtgcataaggtcatgtatgtaaaactacttgctttgttgatcattctgtcccagataagtatgaattattatgcatcatttcattaaacaagaaagcttcactgtgtt

SEQ ID NO: 5540 - DNA, 332 bp, Homo sapiens
ctttaagtgaaatatgaaacagagaagcaccatttctgcctcaagacgcatgtaaagaggtgtagattcaggttggagtgcagtggcatgatcacagctctctgcagtctcgccctcctgggctcaagcaatctttccccaccccccggtttcctgagtagctgggactataggcatgcgccaccacacccggatgctctaaacgtccctgccatctggtccagatggagtcctcaggcaacccagagagcaccacctttttttactatgaccttcagagccagccgtgtgagaaccaggcctgggtctttgctaccctcgccaccactgtc

SEQ ID NO: 5541 - DNA, 1373 bp, Homo sapiens
ctttaagtgaaatatgaaacagagaagcaccatttctgcctcaagacgcatgtaaagaggtgtagattcaggttggagtgcagtggcatgatcacagctctctgcagtctcgccctcctgggctcaagcaatctttccccaccccccggtttcctgagtagctgggactataggcatgcgccaccacacccggatgctctaaacgtccctgccatctggtccagatggagtcctcaggcaacccagagagcaccacctttttttactatgaccttcagagccagccgtgtgagaaccaggcctgggtctttgctaccctcgccaccactgtcctatactgcctggtgtttctcctcagcctagtgggcaacagcctggtcctgtgggtcctggtgaagtatgagagcctggagtccctcaccaacatcttcatcctcaacctgtgcctctcagacctggtgttcgcctgcttgttgcctgtgtggatctccccataccactggggctgggtgctgggagacttcctctgcaaactcctcaatatgatcttctccatcagcctctacagcagcatcttcttcctgaccatcatgaccatccaccgctacctgtcggtagtgagccccctctccaccctgcgcgtccccaccctccgctgccgggtgctggtgaccatggctgtgtgggtagccagcatcctgtcctccatcctcgacaccatcttccacaaggtgctttcttcgggctgtgattattccgaactcacgtggtacctcacctccgtctaccagcacaacctcttcttcctgctgtccctggggattatcctgttctgctacgtggagatcctcaggaccctgttccgctcacgctccaagcggcgccaccgcacggtcaagctcatcttcgccatcgtggtggcctacttcctcagctggggtccctacaacttcaccctgtttctgcagacgctgtttcggacccagatcatccggagctgcgaggccaaacagcagctagaatacgccctgctcatctgccgcaacctcgccttctcccactgctgctttaacccggtgctctatgtcttcgtgggggtcaagttccgcacacacctgaaacatgttctccggcagttctggttctgccggctgcaggcacccagcccagcctcgatcccccactcccctggtgccttcgcctatgagggcgcctccttctactgaggggcctgtggcggtgcaggcgcaggtgcaggtggacagggactggaatgggggtcatggagaagcgggcctggaaggagcattgcagaacacagcagggtggagacgtctcctccgctgcaggcgtgcagtgaaggtcattcatta

SEQ ID NO: 5542 - DNA, 520 bp, Homo sapiens
accaggctcatcaaagctgctccaggaaggcccaagccagaccagaagacatgcagatcatcaccacagccctggtgtgcttgctgctagctgggatgtggccggaagatgtggacagcaagagcatgcaggtacccttctccagatgttgcttctcatttgcggagcaagagattcccctgagggcaatcctgtgttacagaaataccagctccatctgctccaatgagggcttaatattcaagctgaagagaggcaaagaggcctgcgccttggacacagttggatgggttcagaggcacagaaaaatgctgaggcactgcccgtcaaaaagaaaatgagcagatttctttccattgtgggctctggaaaccacatggcttcacctgtccccgaaactaccagccctacaccattccttctgccctgcttttgctaggtcacagaggatctgcttggtcttgataagctatgttgttgcactttaaacatttaaattatacaatcatcaacccccaac

SEQ ID NO: 5543 - DNA, 851 bp, Homo sapiens
aaaaggccggcggaacagccagaggagcagagaggcaaagaaacattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggtttgtattcggttcccaggggttgagagcatgcctgtgggagtcatggacatgaagggatgctgcaatgtaggaaggagagctctttgtgaatgtgaggtgttgctaaatatgttattgtggaaagatgaatgcaatagtaggactgctgacattttgcagaaaatacattttatttaaaatctccta

SEQ ID NO: 5544 - DNA, 850 bp, Homo sapiens
ccgcaggagcctctgaagctcccaccaggccagctctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttccctggcctcattcctttctacgggatttactcattggccatgcactgaggacaccagggtgtggcaccctcggcatcaagcctcgctctgcagaagttttgctggagcctggtacaaaaaataggtcaggcctgcaatgcaggtagtgagaagcagaaagtgagaaagaaaagcagtgtaaagaccgtctcctcctcagcaacaacagtagcagaccccgttttcttaatgctttctatactccaagcactctgctaggcagtctgtatgcattatcttatttaagcttcatgacaagtgtaaaagctacaaatcatcatttgattttttaggtaacacttcataaagggctctctatagca

SEQ ID NO: 5545 - DNA, 554 bp, Homo sapiens
tttctcaacaattcctcaccgcaggagcctctgaagctcccaccaggccagctctcctcccacaacagcttcccacagcatgaagatctccgtggctgccattcccttcttcctcctcatcaccatcgccctagggaccaagactgaatcctcctcacaaactggggggaaaccgaaggttgttaaaatacagctaaagttggtggggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttc

SEQ ID NO: 5546 - DNA, 1487 bp, Homo sapiens
cctgctctaaatcttgtctcggtctctcactctgccttatacccctcagttgaattatttcttctgaggaggcaagaactgaggctgctgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacagttcaagtcatctttgtcctctactttctgttgcactctcagccttgttctctttttagaaactgcatggtaactattatatagctaaagaagagcattctgacctctgccctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcataaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgagcctctgaagctcccaccaggccagctctcctcccacaacagcttcccacagcatgaagatctccgtggctgccattcccttcttcctcctcatcaccatcgccctagggaccaagactgaatcctcctcacaaactggggggaaaccgaaggttgttaaaatacagctaaagttggtggggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttc

SEQ ID NO: 5547 - DNA, 542 bp, Homo sapiens
ggagccaggaagcagtgagcccaggagtcctcggccagccctgcctgcccaccaggaggatgaaggtctccgtggctgccctctcctgcctcatgcttgttgctgtccttggatcccaggcccagttcataaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgtgagtttcttggtctgaaatacttaaaaaatatatatattgttgtgtctggtaatgaaagtaatgcatctaataaagagtattcaattttttaa

SEQ ID NO: 5548 - DNA, 718 bp, Homo sapiens
gctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctagatctgagcctggaacaggtgttgcagagaagcagaaaaagagaggactcacaccagttgactcttgtggcatgattttggatgtggcattggagctggtctctctaggattctacctcggcctcccaggttcaagcaattctcctgcctcagcctccctactagctgggattacgtgcctgccaccagacctgactaatttctgtatttttagtagagacagggtttcgccttgttggtcaggctggtctcaaactcctaacctcagatgatccacccacctcggcctcccaaagtactggaattaacggcatgagccactgcactcagcctctacctacttttcaagccttcctgatactacctaaaatctttgcagtaaagtcctttttgcttaatcaaccagagtcagtttgtatagctttccaacaaaaaactccaactgatatgaacaataaactttctgggactttgaaggtctaaaaa

SEQ ID NO: 5549 - DNA, 929 bp, Homo sapiens
ggagccaggaagcagtgagcccaggagtcctcggccagccctgcctgcccaccaggaggatgaaggtctccgtggctgccctctcctgcctcatgcttgttgctgtccttggatcccaggcccagttcataaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgagcctctgaagctcccaccaggccagctctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttc

SEQ ID NO: 5550 - DNA, 977 bp, Homo sapiens
ggagccaggaagcagtgagcccaggagtcctcggccagccctgcctgcccaccaggaggatgaaggtctccgtggctgccctctcctgcctcatgcttgttgctgtccttggatcccaggcccagttcataaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgagcctctgaagctcccaccaggccagctctcctcccacaacagcttcccacagcatgaagatctccgtggctgccattcccttcttcctcctcatcaccatcgccctagggaccaagactgaatcctcctcacaaactggggggaaaccgaaggttgttaaaatacagctaaagttggtggggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttc

SEQ ID NO: 5551 - DNA, 1506 bp, Homo sapiens
gttggcaagcggaccaccagcaacagacaacatcttcattcggctctccctgaagctgtactgcctcgctgagaggatgaaggtctccgaggctgccctgtctctccttgtcctcatccttatcattacttcggcttctcgcagccagccaaaagttcctgagtgggtgaacaccccatccacctgctgcctgaagtattatgagaaagtgttgccaaggagactagtggtgggatacagaaaggccctcaactgtcacctgccagcaatcatcttcgtcaccaagaggaaccgagaagtctgcaccaaccccaatgacgactgggtccaagagtacatcaaggatcccaacctacctttgctgcctaccaggaacttgtccacggttaaaattattacagcaaagaatggtcaaccccagctcctcaactcccagtgatgaccaggctttagtggaagcccttgtttacagaagagaggggtaaacctatgaaaacaggggaagccttattaggctgaaactagccagtcacattgagagaagcagaacaatgatcaaaataaaggagaagtatttcgaatattttctcaatcttaggaggaaataccaaagttaagggacgtgggcagaggtacgctcttttatttttatatttatatttttatttttttgagatagggtcttactctgtcacccaggctggagtgcagtggtgtgatcttggctcacttgatcttggctcactgtaacctccacctcccaggctcaagtgatcctcccaccccagcctcctgagtagctgggactacaggcttgcgccaccacacctggctaatttttgtatttttggtagagacgggattctaccatgttgcccaggctggtctcaaactcgtgtgcccaagcaatccacctgcctcagccttccaaaagtgctgggattacaggcgtgagccaccacatccggccagtgcactcttaatacacagaaaaatatatttcacatccttctcctgctctctttcaattcctcacttcacaccagtacacaagccattctaaatacttagccagtttccagccttccagatgatctttgccctctgggtcttgacccattaagagccccatagaactcttgatttttcctgtccatctttatggatttttctggatctatattttcttcaattattctttcattttataatgcaactttttcataggaagtccggatgggaatattcacattaatcatttttgcagagactttgctagatcctctcatattttgtcttcctcagggtggcaggggtacagagagtgcctgattggaaaaaaaaaaaaaagagagagagagagaagaagaagaagaagagacacaaatctctacctcccatgttaagctttgcaggacagggaaagaaagggtatgagacacggctaggggtaaactcttagtccaaaacccaagcatgcaataaataaaactcccttatttgaca

SEQ ID NO: 5552 - DNA, 615 bp, Homo sapiens
gctcagagagaagtgactttgagctcacagtgtcaccgcctgctgatgggagagctgaattcaaaaccagggtgtctccctgagcagagggacctgcacacagagactccctcctgggctcctggcaccatggccccactgaagatgctggccctggtcaccctcctcctgggggcttctctgcagcacatccacgcagctcgagggaccaatgtgggccgggagtgctgcctggagtacttcaagggagccattccccttagaaagctgaagacgtggtaccagacatctgaggactgctccagggatgccatcgtttttgtaactgtgcagggcagggccatctgttcggaccccaacaacaagagagtgaagaatgcagttaaatacctgcaaagccttgagaggtcttgaagcctcctcaccccagactcctgactgtctcccgggactacctgggacctccaccgttggtgttcaccgcccccaccctgagcgcctgggtccaggggaggccttccagggacgaagaagagccacagtgagggagatcccatccccttgtctgaactggagccatgggcacaaagggcccagattaaagtctttatcctc

SEQ ID NO: 5553 - DNA, 1324 bp, Homo sapiens
gccaggagttgtgagtttccaagccccagctcactctgaccacttctctgcctgcccagcatcatgaagggccttgcagctgccctccttgtcctcgtctgcaccatggccctctgctcctgtgcacaagttggtaccaacaaagagctctgctgcctcgtctatacctcctggcagattccacaaaagttcatagttgactattctgaaaccagcccccagtgccccaagccaggtgtcatcctcctaaccaagagaggccggcagatctgtgctgaccccaataagaagtgggtccagaaatacatcagcgacctgaagctgaatgcctgaggggcctggaagctgcgagggcccagtgaacttggtgggcccaggagggaacaggagcctgagccagggcaatggccctgccaccctggaggccacctcttctaagagtcccatctgctatgcccagccacattaactaactttaatcttagtttatgcatcatatttcattttgaaattgatttctattgttgagctgcattatgaaattagtattttctctgacatctcatgacattgtctttatcatcctttcccctttcccttcaactcttcgtacattcaatgcatggatcaatcagtgtgattagctttctcagcagacattgtgccatatgtatcaaatgacaaatctttattgaatggttttgctcagcaccaccttttaatatattggcagtacttattatataaaaggtaaaccagcattctcactgtgacgactctgttgattttgtttcactaatcggaatcacagactgagaggaattctgggggaggagtagggaaatatgaaaaggggcagaaacagcaagatagggaccaagtacttctacagtcataccagacatttccctggagatactttcctgaaaagttgaaacagacaccattagtttataaaccatattgtaactgaaatgtgatagaaaaattttctacttaaatgaatatcaagatgacgctgcaatgcatatttacgcacacaagctcattttcataaatgaagctttcctcagaatgatggctaacatctgttgaggtcttaccaagtgctgggttttgggctaagtacttatattagtaaaagtctagcaaatactgcccatagtctagcaaggactccttacctggaagttgctgaaagccttggtaatgttatctttgttctccactctgcttttggggaggatgttttccatgactatacgagatgaggcttggggctgggtggccagagttagcaaataaaaatacagaatggatacta

SEQ ID NO: 5554 - DNA, 687 bp, Homo sapiens
cattcccagcctcacatcactcacaccttgcatttcacccctgcatcccagtcgccctgcagcctcacacagatcctgcacacacccagacagctggcgctcacacattcaccgttggcctgcctctgttcaccctccatggccctgctactggccctcagcctgctggttctctggacttccccagccccaactctgagtggcaccaatgatgctgaagactgctgcctgtctgtgacccagaaacccatccctgggtacatcgtgaggaacttccactaccttctcatcaaggatggctgcagggtgcctgctgtagtgttcaccacactgaggggccgccagctctgtgcacccccagaccagccctgggtagaacgcatcatccagagactgcagaggacctcagccaagatgaagcgccgcagcagttaacctatgaccgtgcagagggagcccggagtccgagtcaagcattgtgaattattacctaacctggggaaccgaggaccagaaggaaggaccaggcttccagctcctctgcaccagacctgaccagccaggacagggcctggggtgtgtgtgagtgtgagtgtgagcgagagggtgagtgtggtcagagtaaagctgctccacccccagattgcaatgctaccaataaagccgcctggtgtttacaactaattg

SEQ ID NO: 5555 - DNA, 414 bp, Homo sapiens
tcctgcacacacccagacagctggcgctcacacattcaccgttggcctgcctctgttcaccctccatggccctgctactggccctcagcctgctggttctctggacttccccagccccaactctgagtggcaccaatgatgctgaagactgctgcctgtctgtgacccagaaacccatccctgggtacatcgtgaggaacttccactaccttctcatcaaggatggctgcagggtgcctgctgtagtgttcaccacactgaggggccgccagctctgtgcacccccagaccagccctgggtagaacgcatcatccagagactgcagaggacctcagccaaggcaagcctggccctccctggccctgtctcctccctctgagctcctgtctaagattccagcccatgatccttcc

SEQ ID NO: 5556 - DNA, 800 bp, Homo sapiens
cactcccaaagaactgggtactcaacactgagcagatctgttctttgagctaaaaaccatgtgctgtaccaagagtttgctcctggctgctttgatgtcagtgctgctactccacctctgcggcgaatcagaagcagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagtaaaaaagtcaagaacatgtaaaaactgtggcttttctggaatggaattggacatagcccaagaacagaaagaaccttgctggggttggaggtttcacttgcacatcatggagggtttagtgcttatctaatttgtgcctcactggacttgtccaattaatgaagttgattcatattgcatcatagtttgctttgtttaagcatcacattaaagttaaactgtattttatgttatttatagctgtaggttttctgtgtttagctatttaatactaattttccataagctattttggtttagtgcaaagtataaaattatatttgggggggaataagattatatggactttcttgcaagcaacaagctattttttaaaaaaaactatttaacattcttttgtttatattgttttgtctcctaaattgttgtaattgcattataaaataagaaaaatattaataagacaaatatt

SEQ ID NO: 5557 - DNA, 831 bp, Homo sapiens
agaatataacagcactcccaaagaactgggtactcaacactgagcagatctgttctttgagctaaaaaccatgtgctgtaccaagagtttgctcctggctgctttgatgtcagtgctgctactccacctctgcggcgaatcagaagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagtaaaaaagtcaagaacatgtaaaaactgtggcttttctggaatggaattggacatagcccaagaacagaaagaaccttgctggggttggaggtttcacttgcacatcatggagggtttagtgcttatctaatttgtgcctcactggacttgtccaattaatgaagttgattcatattgcatcatagtttgctttgtttaagcatcacattaaagttaaactgtattttatgttatttatagctgtaggttttctgtgtttagctatttaatactaattttccataagctattttggtttagtgcaaagtataaaattatatttgggggggaataagattatatggactttcttgcaagcaacaagctattttttaaaaaaaactatttaacattcttttgtttatattgttttgtctcctaaattgttgtaattgcattataaaataagaaaaatattaataagacaaatattgaaaataaagaaacaaaaagtt

SEQ ID NO: 5558 - DNA, 852 bp, Homo sapiens
cttgcagctgcccacctcaccctcagctctggcctcttactcaccctctaccacagacatggctcagtcactggctctgagcctccttatcctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcagctgatgcagcatctggacaagacaccatccccacagaaaccagcccagggctgcaggaaggacaggggggcctccaagactggcaagaaaggaaagggctccaaaggctgcaagaggactgagcggtcacagacccctaaagggccatagcccagtgagcagcctggagccctggagaccccaccagcctcaccagcgcttgaagcctgaacccaagatgcaagaaggaggctatgctcaggggccctggagcagccaccccatgctggccttgccacactctttctcctgctttaaccaccccatctgcattcccagctctaccctgcatggctgagctgcccacagcaggccaggtccagagagaccgaggagggagagtctcccagggagcatgagaggaggcagcaggactgtccccttgaaggagaatcatcaggaccctggacctgatacggctccccagtacaccccacctcttccttgtaaatatgatttatacctaactgaataaaaagctgttctgtcttcccacccaa

SEQ ID NO: 5559 - DNA, 599 bp, Homo sapiens
gacatggctcagtcactggctctgagcctccttatcctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcagctgatgcagcatctggacaagacaccatccccacagaaaccagcccagggctgcaggaaggacaggggggcctccaagactggcaagaaaggaaagggctccaaaggctgcaagaggtgaggaatctgagggatgtgggtaaaggggagcctcagtcagcccctcacacccctcttctgccctcacaggactgagcggtcacagacccctaaagggccatagcccagtgagcagcctggagccctggagaccccaccagcctcaccagcgcttgaagcctgaacccaagatgcaagaaggaggctatgctcaggggccctggagcagccaccccatgctgg

SEQ ID NO: 5560 - DNA, 2929 bp, Homo sapiens
tatgtccctttgcagacacctgggctgagacatacaggacagagcatggatcgcctacagactgcactcctggttgtcctcgtcctccttgctgtggcgcttcaagcaactgaggcaggcccctacggcgccaacatggaagacagcgtctgctgccgtgattacgtccgttaccgtctgcccctgcgcgtggtgaaacacttctactggacctcagactcctgcccgaggcctggcgtggtgttgctaaccttcagggataaggagatctgtgccgatcccagagtgccctgggtgaagatgattctcaataagctgagccaatgaagagcctactctgatgaccgtggccttggctcctccaggaaggctcaggagccctacctccctgccattatagctgctccccgccagaagcctgtgccaactctctgcattccctgatctccatccctgtggctgtcacccttggtcacctccgtgctgtcactgccatctcccccctgacccctctaacccatcctctgcctccctccctgcagtcagagggtcctgttcccatcagcgattcccctgcttaaacccttccatgactccccactgccctaagctgaggtcagtctcccaagcctggcatgtggccctctggatctgggttccatctctgtctccagcctgcccacttcccttcatgaatgttgggttctagctccctgttctccaaacccatactacacatcccacttctgggtctttgcctgggatgttgctgacacccagaaagtcccaccacctgcacatgtgtagccccaccagccctccaaggcattgctcgcccaagcagctggtaattccatttcatgtattagatgtcccctggccctctgtcccctcttaataaccctagtcacagtctccgcagattcttgggatttgggggttttctcccccacctctccactagttggaccaaggtttctagctaagttactctagtctccaagcctctagcatagagcactgcagacaggccctggctcagaatcagagcccagaaagtggctgcagacaaaatcaataaaactaatgtccctcccctctccctgccaaaaggcagttacatatcaatacagagactcaaggtcactagaaatgggccagctgggtcaatgtgaagccccaaatttgcccagattcacctttcttcccccactccctttttttttttttttttgagatggagtttcgctcttgtcacccacgctggagtgcaatggtgtggtcttggcttattgaagcctctgcctcctgggttcaagtgattctcttgcctcagcctcctgagtagctgggattacaggttcctgctaccacgcccagctaatttttgtatttttagtagagacgaggcttcaccatgttggccaggctggtctcgaactcctgtcctcaggtaatccgcccacctcagcctcccaaagtgctgggattacaggcgtgagccacagtgcctggcctcttccctctccccaccccccccccaacttttttttttttttatggcagggtctcactctgtcgcccaggctggagtgcagtggcgtgatctcggctcactacaacctcgacctcctgggttcaagcgattctcccaccccagcctcccaagtagctgggattacaggtgtgtgccactacggctggctaatttttgtatttttagtagagacaggtttcaccatattggccaggctggtcttgaactcctgacctcaagtgatccaccttccttgtgctcccaaagtgctgagattacaggcgtgagctatcacacccagcctccccctttttttcctaataggagactcctgtacctttcttcgttttacctatgtgtcgtgtctgcttacatttccttctcccctcaggctttttttgggtggtcctccaacctccaatacccaggcctggcctcttcagagtaccccccattccactttccctgcctccttccttaaatagctgacaatcaaattcatgctatggtgtgaaagactacctttgacttggtattataagctggagttatatatgtatttgaaaacagagtaaatacttaagaggccaaatagatgaatggaagaattttaggaactgtgagagggggacaaggtggagctttcctggccctgggaggaagctggctgtggtagcgtagcgctctctctctctgtctgtggcaggaggcaaagagtagggtgtaattgagtgaaggaatcctgggtagagaccattctcaggtggttgggccaggctaaagactgggatttgggtctatctatgcctttctggctgatttttgtagagacggggttttgccatgttacccaggctggtctcaaactcctgggctcaagcgatcctcctggctcagcctcccaaagtgctgggattacaggcgtgagtcactgcgcctggcttcctcttcctcttgagaaatattcttttcatacagcaagtatgggacagcagtgtcccaggtaaaggacataaatgttacaagtgtctggtcctttctgagggaggctggtgccgctctgcagggtatttgaacctgtggaattggaggaggccatttcactccctgaacccagcctgacaaatcacagtgagaatgttcaccttataggcttgctgtggggctcaggttgaaagtgtggggagtgacactgcctaggcatccagctcagtgtcatccagggcctgtgtccctcccgaacccagggtcaacctgcctaccacaggcactagaaggacgaatctgcctactgcccatgaacggggccctcaagcgtcctgggatctccttctccctcctgtcctgtccttgcccctcaggactgctggaaaataaatcctttaaaatagt

SEQ ID NO: 5561 - DNA, 625 bp, Homo sapiens
ctggcatcccgagaagccaggaagcagtgagcccaggagtcctcggccagccctgcctgcccaccaggaggatgaaggtctccgtggctgccctctcctgcctcatgcttgttactgcccttggatcccaggcccgggtcacaaaagatgcagagacagagttcatgatgtcaaagcttccattggaaaatccagtacttctggacatgctctggaggagaaagattggtcctcagatgaccctttctcatgctgcaggattccatgctactagtgctgactgctgcatctcctacaccccacgaagcatcccgtgttcactcctggagagttactttgaaacgaacagcgagtgctccaagccgggtgtcatcttcctcaccaagaaggggcgacgtttctgtgccaaccccagtgataagcaagttcaggtttgcgtgagaatgctgaagctggacacacggatcaagaccaggaagaattgaacttgtcaaggtgaagggacacaagttgccagccaccaactttcttgcctcaactaccttcctgaattattttttaaagaagcatttattcttgtgttctggatttagagcaattcatctaataaacagtttctcacttt

SEQ ID NO: 5562 - DNA, 569 bp, Homo sapiens
tcccgagaagccaggaagcagtgagcccaggagtcctcggccagccctgcctgcccaccaggaggatgaaggtctccgtggctgccctctcctgcctcatgcttgttactgcccttggatcccaggcccgggtcacaaaagatgcagagacagagttcatgatgtcaaagcttccattggaaaatccagtacttctggacagattccatgctactagtgctgactgctgcatctcctacaccccacgaagcatcccgtgttcactcctggagagttactttgaaacgaacagcgagtgctccaagccgggtgtcatcttcctcaccaagaaggggcgacgtttctgtgccaaccccagtgataagcaagttcaggtttgcgtgagaatgctgaagctggacacacggatcaagaccaggaagaattgaacttgtcaaggtgaagggacacaagttgccagccaccaactttcttgcctcaactaccttcctgaattattttttaaagaagcatttattcttgtgttctggatttagagcaattcatctaataaacagtttctcactttt

SEQ ID NO: 5563 - DNA, 582 bp, Homo sapiens
actctgcaaggacccgagctatttatccctaggtcctttcctcctgcacgtcagctttgagccccgagctggtgcttctgctctctgagacatggcaggcctgatgaccatagtaaccagccttctgttccttggtgtctgtgcccaccacatcatccctacgggctctgtggtcatcccctctccctgctgcatgttctttgtttccaagagaattcctgagaaccgagtggtcagctaccagctgtccagcaggagcacatgcctcaaggcaggagtgatcttcaccaccaagaagggccagcagttctgtggcgaccccaagcaggagtgggtccagaggtacatgaagaacctggacgccaagcagaagaaggcttcccctagggccagggcagtggctgtcaagggccctgtccagagatatcctggcaaccaaaccacctgctaatccccgcccagccctccagccctgagtttgggcctgagctgcttggcgggctactcggggcctggagaagccacagtgatggggggaagagctaattttcctgtttcttagcaacactctccagggatgtg

SEQ ID NO: 5564 - DNA, 585 bp, Homo sapiens
acttggcaccaaggctgtcaccctgttacctccgggtcctttcctcctgcacgtcagctttgagccccgagctggtgcttctgctctctgagacatggcaggcctgatgaccatagtaaccagccttctgttccttggtgtctgtgcccaccacatcatccctacgggctctgtggtcatcccctctccctgctgcatgttctttgtttccaagagaattcctgagaaccgagtggtcagctaccagctgtccagcaggagcacatgcctcaaggcaggagtgatcttcaccaccaagaagggccagcagttctgtggcgaccccaagcaggagtgggtccagaggtacatgaagaacctggacgccaagcagaagaaggcttcccctagggccagggcagtggctgtcaagggccctgtccagagatatcctggcaaccaaaccacctgctaatccccgcccagccctccagccctgagtttgggcctgagctgcttggcgggctactcggggcctggagaagccacagtgatggggggaagagctaattttcctgtttcttagcaacactctccagggatgtg

SEQ ID NO: 5565 - DNA, 953 bp, Homo sapiens
ggacagcttggcctacagcccggcgggcatcagctcccttgacccagtggatatcggtggccccgttattcgtccaggtgcccagggaggaggacccgcctgcagcatgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatattctacctccccaagagacacaggaaggtgtgtgggaaccccaaaagcagggaggtgcagagagccatgaagctcctggatgctcgaaataaggtttttgcaaagctccaccacaacacgcagaccttccaaggccctcatgctgtaaagaagttgagttctggaaactccaagttatcatcgtccaagtttagcaatcccatcagcagcagtaagaggaatgtctccctcctgatatcagctaattcaggactgtgagccggctcatttctgggctccatcggcacaggaggggccggatctttctccgataaaaccgtcgccctacagacccagctgtccccacgcctctgtcttttgggtcaagtcttaatccctgcacctgagttggtcctccctctgcacccccaccacctcctgcccgtctggcaactggaaagagggagttggcctgattttaagccttttgccgctccggggaccagcagcaatcctgggcagccagtggctcttgtagagaagacttaggatacctctctcactttctgtttcttgccgtccaccccgggccatgccagtgtgtccctctgggtccctccaaaactctggtcagttcaaggatgcccctcccaggctatgcttttctataactttt

SEQ ID NO: 5566 - DNA, 361 bp, Homo sapiens
ggacagcttggcctacagcccggcgggcatcagctcccttgacccagtggatatcggtggccccgttattcgtccaggtgcccagggaggaggacccgcctgcagcatgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatcaggccctcatgctgtaaagaagttgagttctggaaactccaagttatcatcgtccaagtttag

SEQ ID NO: 5567 - DNA, 924 bp, Homo sapiens
gtggccccgttattcgtccaggtgcccagggaggaggacccgcctgcagcatgaacctgtggctcctggcctgcctggtggccggcttcctgggagcctgggcccccgctgtccacacccaaggtgtctttgaggactgctgcctggcctaccactaccccattgggtgggctgtgctccggcgcgcctggacttaccggatccaggaggtgagcgggagctgcaatctgcctgctgcgatattctacctccccaagagacacaggaaggtgtgtgggaaccccaaaagcagggaggtgcagagagccatgaagctcctggatgctcgaaataaggtttttgcaaagctccaccacaacacgcagaccttccaagcaggccctcatgctgtaaagaagttgagttctggaaactccaagttatcatcgtccaagtttagcaatcccatcagcagcagtaagaggaatgtctccctcctgatatcagctaattcaggactgtgagccggctcatttctgggctccatcggcacaggaggggccggatctttctccgataaaaccgtcgccctacagacccagctgtccccacgcctctgtcttttgggtcaagtcttaatccctgcacctgagttggtcctccctctgcacccccaccacctcctgcccgtctggcaactggaaagagggagttggcctgattttaagccttttgccgctccggggaccagcagcaatcctgggcagccagtggctcttgtagagaagacttaggatacctctctcactttctgtttcttgccgtccaccccgggccatgccagtgtgtccctctgggtccctccaaaactctggtcagttcaaggatgcccctcccaggctatgcttttctataacttttaaataaaccttggggggtgatgga

SEQ ID NO: 5568 - DNA, 526 bp, Homo sapiens
cagggccgtctcagtctcataaaaggggatcaggcaggaggagtttgggagaaacctgagaagggcctgatttgcagcatcatgatgggcctctccttggcctctgctgtgctcctggcctccctcctgagtctccaccttggaactgccacacgtgggagtgacatatccaagacctgctgcttccaatacagccacaagccccttccctggacctgggtgcgaagctatgaattcaccagtaacagctgctcccagcgggctgtgatattcactaccaaaagaggcaagaaagtctgtacccatccaaggaaaaaatgggtgcaaaaatacatttctttactgaaaactccgaaacaattgtgactcagctgaattttcatccgaggacgcttggaccccgctcttggctctgcagccctctggggagcctgcggaatcttttctgaaggctacatggacccgctggggaggagagggtgtttcctcccagagttactttaataaaggttgttcatagagttga

SEQ ID NO: 5569 - DNA, 703 bp, Homo sapiens
agaacctcagaaatgtgagttatttgggaatggctgtttgtaaatgtccttacgtaagccaagaggaggtcttgacttggggtcccaggggtaccgcagatcccagggactggagcagcactagcaagctctggaggatgagccaggagtctggaattgaggctgagccaaagaccccagggccgtctcagtctcataaaaggggatcaggcaggaggagtttgggagaaacctgagaagggcctgatttgcagcatcatgatgggcctctccttggcctctgctgtgctcctggcctccctcctgagtctccaccttggaactgccacacgtgggagtgacatatccaagacctgctgcttccaatacagccacaagccccttccctggacctgggtgcgaagctatgaattcaccagtaacagctgctcccagcgggctgtgatattcactaccaaaagaggcaagaaagtctgtacccatccaaggaaaaaatgggtgcaaaaatacatttctttactgaaaactccgaaacaattgtgactcagctgaattttcatccgaggacgcttggaccccgctcttggctctgcagccctctggggagcctgcggaatcttttctgaaggctacatggacccgctggggaggagagggtgtttcctcccagagttactttaataaaggttgttcatagagttga

SEQ ID NO: 5570 - DNA, 446 bp, Homo sapiens
cccagataaaaggtaggggaggaggagagagagagaaggaagagtctaggctgagcaacatgaaggggcccccaaccttctgcagcctcctgctgctgtcattgctcctgagcccagaccctacagcagcattcctactgccacccagcactgcctgctgtactcagctctaccgaaagccactctcagacaagctactgaggaaggtcatccaggtggaactgcaggaggctgacggggactgtcacctccaggctttcgtgcttcacctggctcaacgcagcatctgcatccacccccagaaccccagcctgtcacagtggtttgagcaccaagagagaaagctccatgggactctgcccaagctgaattttgggatgctaaggaaaatgggctgaagcccccaatagccaaataataaagcagcattggataataatttctga

SEQ ID NO: 5571 - DNA, 3126 bp, Homo sapiens
aggacacctttagcctcatttcctgatcgaacagcctcacttgtgttgctgtcagtgccagtagggcaggcaggaatgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtaaaggaaatgtttgccacaggaagaaacaccatggcaagaggaacagtaacagggcacatcaggggaaacacgaaacatacggccataaaactccttattagagagtctacagataaatctacagagacaattcctcaagtggacttggccatgattggttgtaagtttatcatctgaattctccttattgtagacaacagaacaaaacaaaatattggtttttaaaaaatgaacaattgtgcggtatgcaaatgtagccaataatatactcaactggaaaatgaaatgaaaagataatactggctgggtatggtggttcacaccttttatcccagcacttcgggaggctgaggcaggaggatcacttgagaccaggagtttgagaccagcctgggcaacatagcaagacctcatttctacaaacaaaaaaaaaattggcccggcatggtagtacttgcctataatcccagccacatgggaggctgaggtgggaggatcacttgagtctgggagagtttgaggttgcagtgagcagcctgggtgacagaatgagaccctgtctctaaaaataataataataatgatagtgtatatcttcatataatattttaagaggagcatatagatataacttctcccaactttttaattatagttttccaaacttacagagaagttaaaagaatggtacaatgaacatctatatatctttcaccacaatattaatcattgttaatattgtgtcacatttgctttctctctcctctctttgtatgtgtttctatataaaatattataacttttaaaatatatcttgttttgctaaaccatttgaaaataagttgcaaaaatcatgacacttcacccctagtttctttttggtgttataacttgacataccctaaaataaagacatttttctacataatcaccttatcagttttatacctaaaaaattaataatttcatctaatatattccatattcaaattttcccaactatttagagagcattttatgtagtttttttttcactccagtaatcaatcaaggttgacatacatattgcaaataattgttatttttctttaatatctttcaatctaagaaagttcctctgtcttttttttttaatttttaaaattattttgttgagggagggtcttgctgtgtcttccaggctggagtgcagtggcacaattttgattttggctcactgaagcctcaacttctagggctcaagcaatcctcccacctcagcctcccgagtatctgggatcaaggtgcatacccaccacacctggctaattttgtttattttttgtagagacagggtctcactatgttgcccaggttgatctcaaactcctgggctcaagcgatcctcccaccttagcctcccaaagtactgggattataggtgtgagccacagtgcctggcctaattattttcttgtgatcaaattcaggtttaatgtttttggttaagaatttcctacgtgaattcgtgtacttattttgtcatttagagttcataaatattagggtttattttctaaatagaatagtttaaactaaatataacttcaaaacgtctagtttgagtagctaccgttgtttggattgaaattttctgatactgaaaagaacaaaaagcctgcctttctgcccagaaccttttgcctcccccagtcagttcttggagcagcactagttaggggcccagagttcggccttctgtgtggtgattttacgctctgcctaaacaaggagcctacatcttttagctcctattccacccttctcacacgtttttgttgttgtttggttgtttttttttgagacagagtctcactctgttgcccaggctggagtgcagtggcacaatctcggctcattgcaacctccgcctcccgcgttcaagtgattctcttgcctcagcctcccaagtaactgatattacaggcgcccagccaccacaccccgctgatttttgtatttttagtagagacggggttttcccacgttggccgggctggtctcaaactcttgacctcaagtgaaccacccgcctgtgcctcccaaagtgctggaattaccagcgtgagccaccatgccgggctcacacgtttgagttgataccattgtgccattcctcttttggcctcttttttgtccatagaggcttcaagatagataggtaagagcccagtagtgttcataagaagccaatagagagcaggagccactttatcaggtggcaggtgtcctgggcctccctgctggctagtcccaagcggtggtgttgccaggatgtcttggaggtgataatgggacacacagaggcactgagtctccataggttaaaatgccaccaaaactggcctttgcctaatatccctcattgactatttagcatttaatttatttattttcctgacatttctgcaagctttgtatttatatttccactttatagatgaggaaatttgaggctcttagaggtaaaatgacttgcccaggtcacacaggaagtggcagagacaagctttttaaataagaaaaaattaataaaatataatatgagagtaacttaaaatattaataaaccacaattttaaattaattaaccgtgataaccaacattaataaaagttaagataccaaaacactggtgtctaattctttcaactaacaacttgaattattttccattttaaattaattaaccgtgataaccaacattaataaaagttaagataccaaaa

SEQ ID NO: 5572 - DNA, 1342 bp, Homo sapiens
catttcctgatcgaacagcctcacttgtgttgctgtcagtgccagtagggcaggcaggaatgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtaaaggaaatgtttgccacaggaagaaacaccatggcaagaggaacagtaacagggcacatcaggggaaacacgaaacatacggccataaaactccttattagagagtctacagataaatctacagagacaattcctcaagtggacttggccatgattggttagtctcactctatcacacaggctggagggcagtggcaggatctcagttcaccccaacctttgcctcacgggttcaagggattctcgtgcctcagccttccaagtagctgggattacaggtgtgcgccagtacgcctggctagttttagtattttttgttacagacggggtttcaccatgttggctgggctggtctcaaacttctgatctcaagtgatccatctgccttggcctcccaaagtgctgggattacaggcatgagccactgcacctggcctacgtattaggctttatgtaagatgtacatagtactccatactcctttccttttcctcctattgaaactgttcctataaactttataaaattaatcagagaagaagagagggtgagaaacataaataatccaagcttgcaccacattcagcattaatcactaggtcactttgcttgctgaccccttcctcatagttgtttggctattgcttcagaattatgtggagtctgttacaagattatagttccccttaactgctctatagataacagcttgaacattatgaaatgctaagttttcccttcgagacattctttcaggtcctgcatactgatgaaactactgatgtcagctggtctgaaggaccctaccagaagctaaatcatcaaagaatgcaatttccatatcctaatgattcaatctcccttaccctgaccaatcagtggcccaaattttccagccccttgcctcccagaaccccagcccagaactcttcagagatttaagaatctcctcctacctcctgactcagcaccatgtaatcattaaactctctgctgcaaa

SEQ ID NO: 5573 - DNA, 1518 bp, Homo sapiens
cccgcggtaggctaggcctggtcctgggcgccccagccggctcccccgggtccaggcgtgcgcctgcgggcgacgtgcgcgtctgggcatccggccgtcacgcgctgcctgggactccaccctacctacccttcgcgtagtacttgttatactttggcagcttcttcacgtcggtcctctccgcgcgcgggtaggaaccgtccacggccttaaagaagcctcctcaccagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtaaaggaaatgtttgccacaggaagaaacaccatggcaagaggaacagtaacagggcacatcaggggaaacacgaaacatacggccataaaactccttattagagagtctacagataaatctacagagacaattcctcaagtggacttggccatgattggttgtaagtttatcatctgaattctccttattgtagacaacagaacaaaacaaaatattggtttttaaaaaatgaacaattgtgcggtatgcaaatgtagccaataatatactcaactggaaaatgaaatgaaaagataatactggctgggtatggtggttcacaccttttatcccagcacttcgggaggctgaggcaggaggatcacttgagaccaggagtttgagaccagcctgggcaacatagcaagacctcatttctacaaacaaaaaaaaaattggcccggcatggtagtacttgcctataatcccagccacatgggaggctgaggtgggaggatcacttgagtctgggagagtttgaggttgcagtgagcagcctgggtgacagaatgagaccctgtctctaaaaataataataataatgatagtgtatatcttcatataatattttaagaggagcatatagatataacttctcccaactttttaattatagttttccaaacttacagagaagttaaaagaatggtacaatgaacatctatatatctttcaccacaatattaatcattgttaatattgtgtcacatttgctttctctctcctctctttgtatgtgtttctatataaaatattataacttttaaaatatatcttgttttgctaaaccatttgaaaataagttgcaaaaatcatgacacttcacccctagtttctttttggtgttataacttgacataccctaaaataaagacatttttctacataatcaccttatcagttttatacctaaaaaattaataatttcatctaatatattccatattcaaattttcccaactatttagagagcattttatgtagtttttttttcactccagtaatcaatcaaggttgacatacatattgc

SEQ ID NO: 5574 - DNA, 354 bp, Homo sapiens
atgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatgctggagtgcagtgacatgatctcagctcactacaacctccacctacctggttcaaacgattctcctacctcagccttccaagtagctgggattacagccttcatgtcaagcgcagaagaatctgtgtcagcccgcacaaccatactgttaagcagtggatga

SEQ ID NO: 5575 - DNA, 772 bp, Homo sapiens
gcagcaaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgcctgaggggtccagaagcttcgaggcccagcgacctcagtgggcccagtggggaggagcaggagcctgagccttgggaacatgcgtgtgacctctacagctacctcttctatggactggttattgccaaacagccacactgtgggactcttcttaacttaaattttaatttatttatactatttagtttttataatttatttttgatttcacagtgtgtttgtgattgtttgctctgagagttccccctgtcccctccaccttccctcacagtgtgtctggtgacaaccgagtggctgtcatcggcctgtgtaggcagtcatggcaccaaagccaccagactgacaaatgtgtatcagatgcttttgttcagggctgtgatcggcctggggaaataataaagatgttcttttaaacggtaaa

SEQ ID NO: 5576 - DNA, 244 bp, Homo sapiens
agaaggacgcaggcagcaaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccactctccagaccaagagaggccggcaggtctgtgctgaccccagtgaggagtgggtccagaaatacgtcagtgacctggagctga

SEQ ID NO: 5577 - DNA, 229 bp, Homo sapiens
agaaggacgcaggcagcaaagagtagtcagtcccttcttggctctgctgacactcgagcccacattccatcacctgctcccaatcatgcaggtctccactgctgcccttgccgtcctcctctgcaccatggctctctgcaaccaggtcctctctgcaccacaggccggcaggtctgtgctgaccccagtgaggagtgggtccagaaatacgtcagtgacctggagctga

SEQ ID NO: 5578 - DNA, 664 bp, Homo sapiens
agcacaggacacagctgggttctgaagcttctgagttctgcagcctcacctctgagaaaacctctttgccaccaataccatgaagctctgcgtgactgtcctgtctctcctcatgctagtagctgccttctgctctccagcgctctcagcaccaatgggctcagaccctcccaccgcctgctgcttttcttacactgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgcagaca

SEQ ID NO: 5579 - DNA, 552 bp, Homo sapiens
agcacaggacacagctgggttctgaagcttctgagttctgcagcctcacctctgagaaaacctctttgccaccaataccatgaagctctgcgtgactgtcctgtctctcctcatgctagtagctgccttctgctctccagcgctctcagcaccaaattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgcagacagtt

SEQ ID NO: 5580 - DNA, 547 bp, Homo sapiens
agcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaaattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaa

SEQ ID NO: 5581 - DNA, 441 bp, Homo sapiens
ccctggggaagagaagctgagaggaactcctcactcagctagcttcaggagccatgacatcatctctaccatggaaattccactcactctcctgtgcccccacatttgtcctaggcctcagagtccctataaagagagattcccaactcagtatcagcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaactaaatccagtgagtggaagttacagggagtctgcttccagtgctgctcgaggaaggatcccatccaccagagctgccccacatggaccatggtcaggcagaggaagatgcctaccacaggcaagggataa

SEQ ID NO: 5582 - DNA, 495 bp, Homo sapiens
ccctggggaagagaagctgagaggaactcctcactcagctagcttcaggagccatgacatcatctctaccatggaaattccactcactctcctgtgcccccacatttgtcctaggcctcagagtccctataaagagagattcccaactcagtatcagcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtagctgccccacatggaccatggtcaggcagaggaagatgcctaccacaggcaagggataaagccagatga

SEQ ID NO: 5583 - DNA, 905 bp, Homo sapiens
agtctcggtcactgcttttggctgtaccacttcccttttcttctcgcctgcacctccctcatctttcctctatgatgacatcgccctggggaagagaagctgagaggaactcctcactcagctagcttcaggagccatgacatcatctctaccatggaaattccactcactctcctgtgcccccacatttgtcctaggcctcagagtccctataaagagagattcccaactcagtatcagcacaggacacagctaggttctgaagcttctgagttctgcagcctcacctctgagaaaacctctttgccaccaataccatgaagctctgcgtgactgtcctgtctctcctcgtgctagtagctgccttctgctctctagcactctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaggcaagcaagtctgcgctgaccccagtgagtcctgggtccaggagtacgtgtatgacctggaactgaactgagctgctcagagacaggaagtcttcagggaaggtcacctgagcctggatgcttctccatgagccgcatctcctccatactcaggactcctctccgcagttcctgtctcttctcttaatgtaatctcttttatgtgctgtattattgtattaggtgttatttccattatttatattagtttagccaaaggataagtgtcccctatggggatggtccactctcactctttctctgctgttgcaaatacatggataacaccgttaattccatgtgttttcataataaaactttaaaataaaatgcaaacagtt

SEQ ID NO: 5584 - DNA, 1249 bp, Homo sapiens
gtgatggagagcaccagcaaagccttagggcccatccctggcctcctgttacccacagaggggtaggcccttggctctcttccactatgacgtcagcttccattcttcctttcttatagacaattttccatttcaaggaaatcagagcccttaatagttcagtgaggtcactttgctgagcacaatcccatacccttcagcctctgctccacagagcctaagcaaaagatagaaactcacaacttccttgttttgttatctggaaattatcccaggatctggtgcttactcagcatattcaaggaaggtcttacttcattcttccttgattgtgaccatgcccaggctctctgctccctataaaaggcaggcagagccaccgaggagcagagaggttgagaacaacccagaaaccttcacctctcatgctgaagctcacacccttgccctccaagatgaaggtttctgcagcgcttctgtgcctgctgctcatggcagccactttcagccctcagggacttgctcagccagattcagtttccattccaatcacctgctgctttaacgtgatcaataggaaaattcctatccagaggctggagagctacacaagaatcaccaacatccaatgtcccaaggaagctgtgatcttcaagaccaaacggggcaaggaggtctgtgctgaccccaaggagagatgggtcagggattccatgaagcatctggaccaaatatttcaaaatctgaagccatgagccttcatacatggactgagagtcagagcttgaagaaaagcttatttattttccccaacctcccccaggtgcagtgtgacattattttattataacatccacaaagagattatttttaaataatttaaagcataatatttcttaaaaagtatttaattatatttaagttgttgatgttttaactctatctgtcatacatcctagtgaatgtaaaatgcaaaatcctggtgatgtgttttttgtttttgttttcctgtgagctcaactaagttcacggcaaaatgtcattgttctccctcctacctgtctgtagtgttgtggggtcctcccatggatcatcaaggtgaaacactttggtattctttggcaatcagtgctcctgtaagtcaaatgtgtgctttgtactgctgttgttgaaattgatgttactgtatataactatggaattttgaaaaaaaatttcaaaaagaaaaaaatatatataatttaaaact

SEQ ID NO: 5585 - DNA, 1261 bp, Homo sapiens
gtgactctagtgtgatggagagcaccagcaaagccttagggcccatccctggcctcctgttacccacagaggggtaggcccttggctctcttccactatgacgtcagcttccattcttcctttcttatagacaattttccatttcaaggaaatcagagcccttaatagttcagtgaggtcactttgctgagcacaatcccatacccttcagcctctgctccacagagcctaagcaaaagatagaaactcacaacttccttgttttgttatctggaaattatcccaggatctggtgcttactcagcatattcaaggaaggtcttacttcattcttccttgattgtgaccatgcccaggctctctgctccctataaaaggcaggcagagccaccgaggagcagagaggttgagaacaacccagaaaccttcacctctcatgctgaagctcacacccttgccctccaagatgaaggtttctgcagcgcttctgtgcctgctgctcatggcagccactttcagccctcagggacttgctcagccagattcagtttccattccaatcacctgctgctttaacgtgatcaataggaaaattcctatccagaggctggagagctacacaagaatcaccaacatccaatgtcccaaggaagctgtgatcttcaagaccaaacggggcaaggaggtctgtgctgaccccaaggagagatgggtcagggattccatgaagcatctggaccaaatatttcaaaatctgaagccatgagccttcatacatggactgagagtcagagcttgaagaaaagcttatttattttccccaacctcccccaggtgcagtgtgacattattttattataacatccacaaagagattatttttaaataatttaaagcataatatttcttaaaaagtatttaattatatttaagttgttgatgttttaactctatctgtcatacatcctagtgaatgtaaaatgcaaaatcctggtgatgtgttttttgtttttgttttcctgtgagctcaactaagttcacggcaaaatgtcattgttctccctcctacctgtctgtagtgttgtggggtcctcccatggatcatcaaggtgaaacactttggtattctttggcaatcagtgctcctgtaagtcaaatgtgtgctttgtactgctgttgttgaaattgatgttactgtatataactatggaattttgaaaaaaaatttcaaaaagaaaaaaatatatataatttaaaacta

SEQ ID NO: 5586 - DNA, 2731 bp, Homo sapiens
atcacacaggaagctgagtacttcctacttggtcaggatcttgaaacttgaattcataaaaacccagaaagccccagaaacaaagacttcacggacaaagtcccttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtcacagccacttgggatagagagggaatgtaatggtggcctggggcttctgaggcttctggggcttcagtcttttccatgaacttctcccctggtagaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaaagaacttggaaatagtgatttccacagtgactccactctgagtcccagagccaatcagtagccagcatctgcctccccttcactcccaccgcaggatttgggctcttggaatcctggggaacatagaactcatgacggaagagttgagacctaacgagaaatagaaatggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcgattaataacaggcaaaaggaagcagggttggtttcccttctttttgttcttcatctaagccttctggttttatgggtcagagttccgactgccatcttggacttgtcagcaaaaaaaaaaaataataataataataaggcctgctgtgtaagctgacagtatttgtagctgatagggggttgggaggaaagtgtctactaggagggtggggtgagattctgtgttgatgtaggaggccgagaaggcccttaactcaaagtagcttatttatccaaaatgttctggatgcatcatctccaaccaaggaccccttatttatcatgcctttgttctcttttccctcagatgtatatttctttaaaaataattttcctaataacaaaacttatttctaaaacagcttaaaaattcaaagaaaaaccccaaacactgacattacctacacttccactacccaaagacaaaatgtgcccactgtgtgcttttgagtgtattttcttttagtttgttttttgttgggtgcatatttatgataataacaatgatggacttcaattgtactcactgttctattgttggttttaattagcagcaagttgtgatcactttcccaggtgaataaatcatttcaaagcatt

SEQ ID NO: 5587 - DNA, 1773 bp, Homo sapiens
agaaacctgtgtagccagagatggggacggaggccacagagcaggtttcctggggccattactctggggatgaagaggacgcatactcggctgagccactgccggagctttgctacaaggccgatgtccaggccttcagccgggccttccaacccagtgtctccctgaccgtggctgcgctgggtctggccggcaatggcctggtcctggccacccacctggcagcccgacgcgcagcgcgctcgcccacctctgcccacctgctccagctggccctggccgacctcttgctggccctgactctgcccttcgcggcagcaggggctcttcagggctggagtctgggaagtgccacctgccgcaccatctctggcctctactcggcctccttccacgccggcttcctcttcctggcctgtatcagcgccgaccgctacgtggccatcgcgcgagcgctcccagccgggccgcggccctccactcccggccgcgcacacttggtctccgtcatcgtgtggctgctgtcactgctcctggcgctgcctgcgctgctcttcagccaggatgggcagcgggaaggccaacgacgctgtcgcctcatcttccccgagggcctcacgcagacggtgaagggggcgagcgccgtggcgcaggtggccctgggcttcgcgctgccgctgggcgtcatggtagcctgctacgcgcttctgggccgcacgctgctggccgccagggggcccgagcgccggcgtgcgctgcgcgtcgtggtggctctggtggcggccttcgtggtgctgcagctgccctacagcctcgccctgctgctggatactgccgatctactggctgcgcgcgagcggagctgccctgccagcaaacgcaaggatgtcgcactgctggtgaccagcggcttggccctcgcccgctgtggcctcaatcccgttctctacgccttcctgggcctgcgcttccgccaggacctgcggaggctgctacggggtgggagctgcccctcagggcctcaaccccgccgcggctgcccccgccggccccgcctttcttcctgctcagctcccacggagacccacagtctctcctgggacaactagggctgcgaatctagaggagggggcaggctgagggtcgtgggaaaggggagtaggtgggggaacactgagaaagaggcagggacctaaagggactacctctgtgccttgccacattaaattgataacatggaaatgagatgcaacccaacaactgttactatttttgagtcaccgacttggaagtgatttgtggcggggcagaaccggtgggttaacaccccgcccccgccccaccccccgccctgccccgcgcttggctctctgagtggaagacgctgagggcctgggtgggggtggggggctgctgagtctgctaaagctctagccactgacaccccctccaccgtcacctggcctcagccaacagaggtgaggtgggaaagctgccaggcaaggaggggcggtggttcctcttgcaatactgtaaggaagagctttctaacaaccagagcgctctccagtaatggctgccttagcaaatactgagttcccgctattggaatgttcagactgtcggggacgctgtgggcctttgcgtggtgtggggggagggggaggggcaggggattcccgtttttggtgggcgtttggatttcataaccactttacaatcccttcctagtgtctgtgatggaaagaaaaaatgaaaaaatgaattgtaaaa

SEQ ID NO: 5588 - DNA, 2671 bp, Homo sapiens
tttattctctggaacatgaaacattctgttgtgctcatatcatgcaaattatcactagtaggagagcagagagtggaaatgttccaggtataaagacccacaagataaagaagctcagagtcgttagaaacaggagcagatgtacagggtttgcctgactcacactcaaggttgcataagcaagatttcaaaattaatcctattctggagacctcaacccaatgtacaatgttcctgactggaaaagaagaactatatttttctgattttttttttcaaatctttaccattagttgccctgtatctccgccttcactttctgcaggaaactttatttcctacttctgcatgccaagtttctacctctagatctgtttggttcagttgctgagaagcctgacataccaggactgcctgagacaagccacaagctgaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaagttggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttg

SEQ ID NO: 5589 - DNA, 2232 bp, Homo sapiens
ggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaagttggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttgataaaag

SEQ ID NO: 5590 - DNA, 563 bp, Homo sapiens
agttgctgagaagcctgacataccaggactgcctgagacaagccacaagctgcttctccagatttcaagaatctggctcagtgatatgaaatacaagacttgtgaaaagtgtcaattgcaagagaaatggaaggataaagtatacagaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacat

SEQ ID NO: 5591 - DNA, 2386 bp, Homo sapiens
accaataccctttattctctggaacatgaaacattctgttgtgctcatatcatgcaaattatcactagtaggagagcagagagtggaaatgttccaggtataaagacccacaagataaagaagctcagagtcgttagaaacaggagcagatgtacagggtttgcctgactcacactcaaggttgcataagcaagatttcaaaattaatcctattctggagacctcaacccaatgtacaatgttcctgactggaaaagaagaactatatttttctgattttttttttcaaatctttaccattagttgccctgtatctccgccttcactttctgcaggaaactttatttcctacttctgcatgccaagtttctacctctagatctgtttggttcagttgctgagaagcctgacataccaggactgcctgagacaagccacaagctgaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggtttataaaacgaggagcagtttgattgttgtttataaagggagataacaatctgtatataacaacaaacttcaagggtttgttgaacaatagaaacctgtaaagcaggtgcccaggaacctcagggctgtgtgtactaatacagactatgtcacccaatgcatatccaacatgtgctcagggaataatccagaaaaactgtgggtagagactttgactctccagaaagctcatctcagctcctgaaaaatgcctcattaccttgtgctaatcctctttttctagtcttcataatttcttcactcaatctctgattctgtcaatgtcttgaaatcaagggccagctggaggtgaagaagagaatgtgacaggcacagatgaatgggagtgagggatagtggggtcagggctgagaggagaaggagggagacatgagcatggctgagcctggacaaagacaaaggtgagcaaagggctcacgcattcagccaggagatgatactggtccttagccccatctgccacgtgtatttaaccttgaagggttcaccaggtcagggagagtttgggaactgcaataacctgggagttttggtggagtccgatgattctcttttgcataagtgcatgacatatttttgctttattacagtttatctatggcacccatgcaccttacatttgaaatctatgaaatatcatgctccattgttcagatgcttcttaggccacatccccctgtctaaaaattcagaaaatttttgtttataaaagatgcattatctatgatatgctaatatatgtatatgcaatata

SEQ ID NO: 5592 - DNA, 2000 bp, Homo sapiens
tgctgggcgaatccctttcttgtctggttcatttggaccctccaaagcccacaggctggaacggctgagtcatccaaacaaaaaaggtggcagcccatccctcccccaggagctctaccctgtctcaagtaggtgctaccctgttgctggtggctggctggaattccaagccagttgatcttatcctgtgaggtcccttggaagtggggcccacagactgacgctgctctgcttcctggattcagccctcttcctaaggagctcatggaccctggccgtcatcaggttcaacctcatattcaactgctgggccttgtcttctggccacacactctctccaaatcagcgatggtggggaactgaggagccagaggccattgtggaagaactccaagaaaacaatctccaggttatcacatctaaagcctgagcaagatttgaggctgggaagaggtggatcccagaattggaagaaggagtggtgacgcctaagctatcactggacatatcaaggacttcactaaattagcagggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagtgcaacactgaagctcttgaagacactgaaatatacacacagcagtagcagtagatgcatgtaccctaaggtcattaccacaggccaggggctgggcagcgtactcatcatcaaccctaaaaagcagagctttgcttctctctctaaaatgagttacctacattttaatgcacctgaatgttagatagttactatatgccgctacaaaaaggtaaaactttttatattttatacattaacttcagccagctattgatataaataaaacattttcacacaatacaataa

SEQ ID NO: 5593 - DNA, 1581 bp, Homo sapiens
atatcaaggacttcactaaattagcaggtaccactggtcttcttgtgcttatccgggcaagaacttatcgaaatacaatagaagtttttacttagaagagattttcagggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagtgcaacactgaagctcttgaagacactgaaatatacacacagcagtagcagtagatgcatgtaccctaaggtcattaccacaggccaggggctgggcagcgtactcatcatcaaccctaaaaagcagagctttgcttctctctctaaaatgagttacctacattttaatgcacctgaatgttagatagttactatatgccgctacaaaaaggtaaaactttttatattttatacattaacttcagccagctattgatataaataaaacattttcacacaatacaataagttaa

SEQ ID NO: 5594 - DNA, 1201 bp, Homo sapiens
tttttcttcttctatcacagggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagt

SEQ ID NO: 5595 - DNA, 400 bp, Homo sapiens
accactggtcttcttgtgcttatccgggcaagaacttatcgaaatacaatagaagtttttacttagaagagattttcagctgctgtggattggattatgccatttggaataagaatgctgttaagagcacacaagccaggttcctcaaggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacc

SEQ ID NO: 5596 - DNA, 212 bp, Homo sapiens
ccactggtcttcttgtgcttatccgggcaagaacttatcgaaatacaatagaagtttttacttagaagagattttcagctgctgtggattggattatgccatttggaataagaatgctgttaagagcacacaagccagggagaagtgaaatgacaacctcactagatacagttgagacctttggtaccacatcctactatgatgacgtgggc

SEQ ID NO: 5597 - DNA, 1796 bp, Homo sapiens
ctgatggtatctctgtttcaggagtggtgacgcctaagctatcactggacatatcaaggacttcactaaattagcaggtaccactggtcttcttgtgcttatccgggcaagaacttatcgaaatacaatagaagtttttacttagaagagattttcagcagatgagaagctggtaacagagaccaaaatagtttggagactaaagaatcattgcacatttcactgctgagttgtattggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagtgcaacactgaagctcttgaagacactgaaatatacacacagcagtagcagtagatgcatgtaccctaaggtcattaccacaggccaggggctgggcagcgtactcatcatcaaccctaaaaagcagagctttgcttctctctctaaaatgagttacctacattttaatgcacctgaatgttagatagttactatatgccgctacaaaaaggtaaaactttttatattttatacattaacttcagccagctattgatataaataaaacattttcacacaatacaataagttaactattttattttctaatgtgcctagttctttccctgcttaatgaaaagcttgttttttcagtgtgaataaataatcgtaagcaaca

SEQ ID NO: 5598 - DNA, 1786 bp, Homo sapiens
ctgatggtatctctgtttcaggagtggtgacgcctaagctatcactggacatatcaaggacttcactaaattagcaggtaccactggtcttcttgtgcttatccgggcaagaacttatcgaaatacaatagaagtttttacttagaagagattttcagctgctgtggattggattatgccatttggaataagaatgctgttaagagcacacaagccaggttcctcaaggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagtgcaacactgaagctcttgaagacactgaaatatacacacagcagtagcagtagatgcatgtaccctaaggtcattaccacaggccaggggctgggcagcgtactcatcatcaaccctaaaaagcagagctttgcttctctctctaaaatgagttacctacattttaatgcacctgaatgttagatagttactatatgccgctacaaaaaggtaaaactttttatattttatacattaacttcagccagctattgatataaataaaacattttcacacaatacaataagttaactattttattttctaatgtgcctagttctttccctgcttaatgaaaagcttgttttttcagtgtgaataaataatcgtaagcaaca

SEQ ID NO: 5599 - DNA, 3095 bp, Homo sapiens
gctcacaggaagccacgcacccttgaaaggcaccgggtccttcttagcatcgtgcttcctgagcaagcctggcattgcctcacagaccttcctcagagccgctttcagaaaagcaagctgcttctggttgggcccagacctgccttgaggagcctgtagagttaaaaaatgaaccccacggatatagcagacaccaccctcgatgaaagcatatacagcaattactatctgtatgaaagtatccccaagccttgcaccaaagaaggcatcaaggcatttggggagctcttcctgcccccactgtattccttggtttttgtatttggtctgcttggaaattctgtggtggttctggtcctgttcaaatacaagcggctcaggtccatgactgatgtgtacctgctcaaccttgccatctcggatctgctcttcgtgttttccctccctttttggggctactatgcagcagaccagtgggtttttgggctaggtctgtgcaagatgatttcctggatgtacttggtgggcttttacagtggcatattctttgtcatgctcatgagcattgatagatacctggcaattgtgcacgcggtgttttccttgagggcaaggaccttgacttatggggtcatcaccagtttggctacatggtcagtggctgtgttcgcctcccttcctggctttctgttcagcacttgttatactgagcgcaaccatacctactgcaaaaccaagtactctctcaactccacgacgtggaaggttctcagctccctggaaatcaacattctcggattggtgatccccttagggatcatgctgttttgctactccatgatcatcaggaccttgcagcattgtaaaaatgagaagaagaacaaggcggtgaagatgatctttgccgtggtggtcctcttccttgggttctggacaccttacaacatagtgctcttcctagagaccctggtggagctagaagtccttcaggactgcacctttgaaagatacttggactatgccatccaggccacagaaactctggcttttgttcactgctgccttaatcccatcatctacttttttctgggggagaaatttcgcaagtacatcctacagctcttcaaaacctgcaggggcctttttgtgctctgccaatactgtgggctcctccaaatttactctgctgacacccccagctcatcttacacgcagtccaccatggatcatgatctccatgatgctctgtagaaaaatgaaatggtgaaatgcagagtcaatgaactttccacattcagagcttacttaaaattgtattttagtaagagattcctgagccagtgtcaggaggaaggcttacacccacagtggaaagacagcttctcatcctgcaggcagctttttctctcccactagacaagtccagcctggcaagggttcacctgggctgaggcatccttcctcacaccaggcttgcctgcaggcatgagtcagtctgatgagaactctgagcagtgcttgaatgaagttgtaggtaatattgcaaggcaaagactattcccttctaacctgaactgatgggtttctccagagggaattgcagagtactggctgatggagtaaatcgctaccttttgctgtggcaaatgggccctctaattaatttcttgcttttgcggaacaatatagataactgtttttctaataacatatctcaggcaaagtatattccattgagccagatgtatgaagaaacaattagcgaagtgatgaaaccagatctcaattatttattgtaaaggattatctgttaattgaaaccaaactttttatactgatataagggtaaggatatgaagacattagccaaggtctgctttccaaacgtgaactacaaggcattcaaaatccaaacatatttatgaaaattcaaacacagtttctcacttgtttgtggacatgttttgttctaattttaacagaggaatattaaaaaattttaaataggctgggcacggtggcctgtaatcccagcactgtgggaggccaaggtgggcggatcacctgaggtcaggagttcgagaccagcctggccaacatggagaaaccctgtctctactaaaaaatacaaaattagccaggtgtggtggcgcatgcctgtaatcccagctactcaggaggctgaggctggagaataacttgaatccgggaggtggaggttgcggtgagccgagatcgcgccattgtactccaacctgggcaaaaagagcgaaactctgtctcaaaaaaaaaaaaaaaaaattaaataatacataggccaagaatacatttatttgaggtcatttacttgtttttttttttttttttttttttgagatggaatcttgctctgtcacccagtctggagtgcagtggcgcgatctcggctcactgcaagctctgcctcacgggttcgcaccattctcctgcctcagcctcccaagtaggtgggactacaggcacctgcccccatgcctggctaattttttgtattttcagtagagatggggtttcaccatgttagcaaggatggttttaatctcctgacctcgtgatccacccgcctcggcctcccaaagtgctgggattacaggtgtgagccatcacgcccggccacttgtttattttttattttattttattttatttttgagatggagtctcactctgtcacccaagctggagtgcagtggcactcggttcactgcaaagtctgcctcccaggttcaagcgattctcctgcctcagcttctcaagcagctgggattagaggtgtgcaccactacgccaggctaatttttgtatttttagtagagatggggtttcaccatattggccaggctagtcttgaactcctgacctcaggtgatctgcctgcttcagcctcccaaagtgctgggattacaggcgtgagccacctcgcccagccaaggtcttttacttgtttataaacagtctcttcataattaaaattaaggattaataaagtatgacaatacctccttaatcattttgaagtgcctgctatcaattgaaataaaaacaatcaactaaaa

SEQ ID NO: 5600 - DNA, 3450 bp, Homo sapiens
acttaatgatttaactccaccctccttcaaaagaaacagcatttcctacttttatactgtctatatgattgatttgcacagctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctgtctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataa

SEQ ID NO: 5601 - DNA, 3637 bp, Homo sapiens
cttcagatagattatatctggagtgaagaatcctgccacctatgtatctggcatagtattctgtgtagtgggatgagcagagaacaaaaacaaaataatccagtgagaaaagcccgtaaataaaccttcagaccagagatctattctctagcttattttaagctcaacttaaaaagaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctgtctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatct

SEQ ID NO: 5602 - DNA, 3633 bp, Homo sapiens
cttcagatagattatatctggagtgaagaatcctgccacctatgtatctggcatagtattctgtgtagtgggatgagcagagaacaaaaacaaaataatccagtgagaaaagcccgtaaataaaccttcagaccagagatctattctctagcttattttaagctcaacttaaaaagaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctgtctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatct

SEQ ID NO: 5603 - DNA, 1292 bp, Homo sapiens
ccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtga

SEQ ID NO: 5604 - DNA, 4018 bp, Homo sapiens
tgcaaacgttcccaaatcttcccagtcggcttgcagagactccttgctcccaggagataaccaggtaaaggagtatgaaagtttgggtacaaactcattgctgcaaattgaaaaccatgcaaaggctgtcttcctctggggagttcaatgcctctctttttcttatcactttaccattggttggactttgattccagggatcctacgattactcaataccctacaggatatacatggttaaccatttgcatttgggcaaataggcgttacttttcaataggaagtggcaatccagaacttgcttttgggcaattctagtagctcaccgcttttttcttaatgactgctagaagctgcatcttattgacagatggtcatcacattggtgagctggagtcatcagattgtggggcccggagtgaggctgaagggagtggatcagagcactgcctgagagtcacctctactttcctgctaccgctgcctgtgagctgaaggggctgaaccatacactcctttttctacaaccagcttgcattttttctgcccacaatgagcggggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccaccggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagcaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaacattttcagaaatattcatgaagcggtcacagatcacagtgtcttttggttacagcacaaaatgatggcagtggtttgaaaaactaaaacagaaaaaaaaatggaagccaacacatcactcattttaggcaaatgtttaaacatttttatctatcagaatgtttattgttgctggttataagcagcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctgtcgtgagtgtctcttgtctaaacgtccattaagctgagagtgctatgaagacaggatctagaataatcttgctcacagctgtgctctgagtgcctagcggagttccagcaaacaaaatggactcaagagagatttgattaatgaatcgtaatgaagttggggtttattgtacagtttaaaatgttagatgtttttaattttttaaataaatggaatactttttttttttttttaaagaaagcaactttactgagacaatgtagaaagaagttttgttccgtttctttaatgtggttgaagagcaatgtgtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggaggctgaggcaagagaatcgcttgaacccaggaggcagaggttgcagtgagccgagatcgtgccattgcactccagcctgggtgacaaagcgagactccatctcaaaaaaaaaaaaaaaaaaaaaggaaagaactgtcatgtaaacataccaacatgtttaaacctgacaatggtgttatttgaaactttatattgttcttgtaagctttaactatatctctctttaaaatgcaaaataatgtcttaagattcaaagtctgtatttttaaagcatggctttggctttgcaaaataaaaaatgtgttttgtacatgaagtaggaatcgtatttcagcttcaaggttcagattgaggggcccactgtttggagaggatggtattcaggctttctcatgtccttcaaatctgttagcgtttgactctagaaatcaaagcaaaggagtggttacccagacacttcttttggtgtgatcaatgcgctgatgtgatctatgaagatgattcatgcttgaaaactagcacagaaacatcttgcttatttgccaaagctgggagatgagcttctctgcataatttaaatgttcagataaatgaagctgacttatttaagcaataaccttttaaacattttagctaagatgtataaaaatgtttccaaaatataccacatactttatttcttcttaaatgtagtacattaggttacatcatttttcttgctgtcttgggcatcaaaacaggtgccatggtaacctgacactctcaggagacattaagatagaaggggctgttcttcagtggttcccattgattctccccatatctttttgctctcaggctctggccgtctcttcctgagccttaactgtgt

SEQ ID NO: 5605 - DNA, 2980 bp, Homo sapiens
caaacgttcccaaatcttcccagtcggcttgcagagactccttgctcccaggagataaccagaagctgcatcttattgacagatggtcatcacattggtgagctggagtcatcagattgtggggcccggagtgaggctgaagggagtggatcagagcactgcctgagagtcacctctactttcctgctaccgctgcctgtgagctgaaggggctgaaccatacactcctttttctacaaccagcttgcattttttctgcccacaatgagcggggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccaccggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagcaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaacattttcagaaatattcatgaagcggtcacagatcacagtgtcttttggttacagcacaaaatgatggcagtggtttgaaaaactaaaacagaaaaaaaaatggaagccaacacatcactcattttaggcaaatgtttaaacatttttatctatcagaatgtttattgttgctggttataagcagcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctgtcgtgagtgtctcttgtctaaacgtccattaagctgagagtgctatgaagacaggatctagaataatcttgctcacagctgtgctctgagtgcctagcggagttccagcaaacaaaatggactcaagagagatttgattaatgaatcgtaatgaagttggggtttattgtacagtttaaaatgttagatgtttttaattttttaaataaatggaatactttttttttttttttaaagaaagcaactttactgagacaatgtagaaagaagttttgttccgtttctttaatgtggttgaagagcaatgtgtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggaggctgaggcaagagaatcgcttgaacccaggaggcagaggttgcagtgagccgagatcgtgccattgcactccagcctgggtgacaaagcgagactccatctcaaaaaaaaaaaaaaaaaa

SEQ ID NO: 5606 - DNA, 3216 bp, Homo sapiens
agtgtatgggtgaaggaggcagcagtgtggccggagaggagagctgggctgggagcacaggaaggtccccaggactctgtggtcatcagtaagagagggcccacgtgtatatgctggtgaacagaaatgtcaaccttttcaaagtctgacatttaagagaaaaaactgtggctgttggtttgtggaacagacagctccttctttattgagtcacctctactttcctgctaccgctgcctgtgagctgaaggggctgaaccatacactcctttttctacaaccagcttgcattttttctgcccacaatgagcggggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccaccggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagcaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaacattttcagaaatattcatgaagcggtcacagatcacagtgtcttttggttacagcacaaaatgatggcagtggtttgaaaaactaaaacagaaaaaaaaatggaagccaacacatcactcattttaggcaaatgtttaaacatttttatctatcagaatgtttattgttgctggttataagcagcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctgtcgtgagtgtctcttgtctaaacgtccattaagctgagagtgctatgaagacaggatctagaataatcttgctcacagctgtgctctgagtgcctagcggagttccagcaaacaaaatggactcaagagagatttgattaatgaatcgtaatgaagttggggtttattgtacagtttaaaatgttagatgtttttaattttttaaataaatggaatactttttttttttttttaaagaaagcaactttactgagacaatgtagaaagaagttttgttccgtttctttaatgtggttgaagagcaatgtgtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggaggctgaggcaagagaatcgcttgaacccaggaggcagaggttgcagtgagccgagatcgtgccattgcactccagcctgggtgacaaagcgagactccatctcaaaaaaaaaaaaaaaaaaaaaggaaagaactgtcatgtaaacataccaacatgtttaaacctgacaatggtgttatttgaaactttatattgttcttgtaagctttaactatatctctctttaaaatgcaaaataatgtcttaagattcaaagtctgtatttttaaagcatggctttggctttgcaaaataaaaaatgtgttttgtacatgaa

SEQ ID NO: 5607 - DNA, 2173 bp, Homo sapiens
agacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaagaaaaagaaaaaaaaagtctttggtaaatggcaaa

SEQ ID NO: 5608 - DNA, 1253 bp, Homo sapiens
tttgtagtgggaggatacctccagagaggctgctgctcattgagctgcactcacatgaggatacagactttgtgaagaaggaattggcaacactgaaacctccagaacaaaggctgtcactaaggtcccgctgccttgatggattatacacttgacctcagtgtgacaacagtgaccgactactactaccctgatatcttctcaagcccctgtgatgcggaacttattcagacaaatggcaagttgctccttgctgtcttttattgcctcctgtttgtattcagtcttctgggaaacagcctggtcatcctggtccttgtggtctgcaagaagctgaggagcatcacagatgtatacctcttgaacctggccctgtctgacctgctttttgtcttctccttcccctttcagacctactatctgctggaccagtgggtgtttgggactgtaatgtgcaaagtggtgtctggcttttattacattggcttctacagcagcatgtttttcatcaccctcatgagtgtggacaggtacctggctgttgtccatgccgtgtatgccctaaaggtgaggacgatcaggatgggcacaacgctgtgcctggcagtatggctaaccgccattatggctaccatcccattgctagtgttttaccaagtggcctctgaagatggtgttctacagtgttattcattttacaatcaacagactttgaagtggaagatcttcaccaacttcaaaatgaacattttaggcttgttgatcccattcaccatctttatgttctgctacattaaaatcctgcaccagctgaagaggtgtcaaaaccacaacaagaccaaggccatcaggttggtgctcattgtggtcattgcatctttacttttctgggtcccattcaacgtggttcttttcctcacttccttgcacagtatgcacatcttggatggatgtagcataagccaacagctgacttatgccacccatgtcacagaaatcatttcctttactcactgctgtgtgaaccctgttatctatgcttttgttggggagaagttcaagaaacacctctcagaaatatttcagaaaagttgcagccaaatcttcaactacctaggaagacaaatgcctagggagagctgtgaaaagtcatcatcctgccagcagcactcctcccgttcctccagcgtagactacattttgtgaggatcaatgaagactaaatataaaaaacattttcttgaatggcatgc

SEQ ID NO: 5609 - DNA, 1247 bp, Homo sapiens
ctttgtgaagaaggaattggcaacactgaaacctccagaacaaaggctgtcactaaggtcccgctgccttgatggattatacacttgacctcagtgtgacaacagtgaccgactactactaccctgatatcttctcaagcccctgtgatgcggaacttattcagacaaatgacctactatctgctggaccagtgggtgtttgggactgtaatgtgcaaagtggtgtctggcttttattacattggcttctacagcagcatgtttttcatcaccctcatgagtgtggacaggtacctggctgttgtccatgccgtgtatgccctaaaggtgaggacgatcaggatgggcacaacgctgtgcctggcagtatggctaaccgccattatggctaccatcccattgctagtgttttaccaagtggcctctgaagatggtgttctacagtgttattcattttacaatcaacagactttgaagtggaagatcttcaccaacttcaaaatgaacattttaggcttgttgatcccattcaccatctttatgttctgctacattaaaatcctgcaccagctgaagaggtgtcaaaaccacaacaagaccaaggccatcaggttggtgctcattgtggtcattgcatctttacttttctgggtcccattcaacgtggttcttttcctcacttccttgcacagtatgcacatcttggatggatgtagcataagccaacagctgacttatgccacccatgtcacagaaatcatttcctttactcactgctgtgtgaaccctgttatctatgcttttgttggggagaagttcaagaaacacctctcagaaatatttcagaaaagttgcagccaaatcttcaactacctaggaagacaaatgcctagggagagctgtgaaaagtcatcatcctgccagcagcactcctcccgttcctccagcgtagactacattttgtgaggatcaatgaagactaaatataaaaaacattttcttgaatggcatgctagtagcagtgagcaaaggtgtgggtgtgaaaggtttccaaaaaaagttcagcatgaaggatgccatatatgttgttgccaacacttggaacacaatgactaaagacatagttgtgcatgcctggcacaacatcaagcctgtgattgtgtttattgatgatgttgaacaagtggtaactttaaaggattctgtatgccaagtgaaaaaaaaagatgtctgacctccttacatat

SEQ ID NO: 5610 - DNA, 1331 bp, Homo sapiens
cacaaagcctgcccctcatcccaggcagagagcaacccagctctttccccagacactgagagctggtggtgcctgctgtcccagggagagttgcatcgccctccacagagcaggcttgcatctgactgacccaccatgacacccacagacttcacatctcctccaggccccgctccagatcaccttccctcgctggcccaggaatccatctccttccaggaccttagcccaggactaacacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctga

SEQ ID NO: 5611 - DNA, 2567 bp, Homo sapiens
gcttcctttctcgtgttgttatcgggtagctgcctgctcagaacccacaaagcctgcccctcatcccaggcagagagcaacccagctctttccccagacactgagagctggtggtgcctgctgtcccagggagagttgcatcgccctccacagagcaggcttgcatctgactgacccaccatgacacccacagacttcacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacagaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgctccctagaaaatgggctggttcttttggccctcttctttctgaggcccactttattctgaggaatacagtgagcagatatgggcagcagccaggtagggcaaaggggtgaagcgcaggccttgctggaaggctatttacttccatgcttctccttttcttactctatagtggcaacattttaaaagcttttaacttagagattaggctgaaaaaaataagtaatggaattcacctttgcatcttttgtgtctttcttatcatgatttggcaaaatgcatcacctttgaaaatatttcacatattggaaaagtgctttttaatgtgtatatgaagcattaattacttgtcactttctttaccctgtctcaatattttaagtgtgtgcaattaaagatcaaatagatacatt

SEQ ID NO: 5612 - DNA, 2512 bp, Homo sapiens
ctttctcgtgttgttatcgggtagctgcctgctcagaacccacaaagcctgcccctcatcccaggcagagagcaacccagctctttccccagacactgagagctggtggtgcctgctgtcccagggagagttgcatcgccctccacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacagaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgctccctagaaaatgggctggttcttttggccctcttctttctgaggcccactttattctgaggaatacagtgagcagatatgggcagcagccaggtagggcaaaggggtgaagcgcaggccttgctggaaggctatttacttccatgcttctccttttcttactctatagtggcaacattttaaaagcttttaacttagagattaggctgaaaaaaataagtaatggaattcacctttgcatcttttgtgtctttcttatcatgatttggcaaaatgcatcacctttgaaaatatttcacatattggaaaagtgctttttaatgtgtatatgaagcattaattacttgtcactttctttaccctgtctcaatattttaagtgtgtgcaattaaagatcaaatagatacat

SEQ ID NO: 5613 - DNA, 1914 bp, Homo sapiens
gtaaagtgaaaacaaaagtagctggagttaggtcatttgattttatactctgtactcaagactgctcctctctgccgactacaacagattggagccatggctttggaacagaaccagtcaacagattattattatgaggaaaatgaaatgaatggcacttatgactacagtcaatatgaactgatctgtatcaaagaagatgtcagagaatttgcaaaagttttcctccctgtattcctcacaatagttttcgtcattggacttgcaggcaattccatggtagtggcaatttatgcctattacaagaaacagagaaccaaaacagatgtgtacatcctgaatttggctgtagcagatttactccttctattcactctgcctttttgggctgttaatgcagttcatgggtgggttttagggaaaataatgtgcaaaataacttcagccttgtacacactaaactttgtctctggaatgcagtttctggcttgtatcagcatagacagatatgtggcagtaactaaagtccccagccaatcaggagtgggaaaaccatgctggatcatctgtttctgtgtctggatggctgccatcttgctgagcataccccagctggttttttatacagtaaatgacaatgctaggtgcattcccattttcccccgctacctaggaacatcaatgaaagcattgattcaaatgctagagatctgcattggatttgtagtaccctttcttattatgggggtgtgctactttatcacagcaaggacactcatgaagatgccaaacattaaaatatctcgacccctaaaagttctgctcacagtcgttatagttttcattgtcactcaactgccttataacattgtcaagttctgccgagccatagacatcatctactccctgatcaccagctgcaacatgagcaaacgcatggacatcgccatccaagtcacagaaagcatcgcactctttcacagctgcctcaacccaatcctttatgtttttatgggagcatctttcaaaaactacgttatgaaagtggccaagaaatatgggtcctggagaagacagagacaaagtgtggaggagtttccttttgattctgagggtcctacagagccaaccagtacttttagcatttaaaggtaaaactgctctgccttttgcttggatacatatgaatgatgctttcccctcaaataaaacatctgcattattctgaaactcaaatctcagacgccgtggttgcaacttataataaagaatgggttgggggaagggggagaaataaaagccaagaagaggaaacaagataataaatgtacaaaacatgaaaattaaaatgaacaatataggaaaataattgtaacaggcataagtgaataacactctgctgtaacgaagaagagctttgtggtgataattttgtatcttggttgcagtggtgcttatacaaatctacacaagtgataaaatgacacagaactatatacacacattgtaccaatttcaatttcctggttttgacattatagtataattatgtaagatggaaccattggggaaaactgggtgaagggtacccaggaccactctgtaccatctttgtaacttcctgtgaatttataataatttcaaaataaaacaagttaaaaaaaaacccactatgctataagttaggccatctaaaacagattattaaagaggttcatgttaaaaggcatttataattatttttaattatctaagttttaatacaagaacgatttccctgcataattttagtacttgaataagtatgcagcagaactccaactatcttttttcctgttttttttaaatttgtaagtaattttataaaatccacctcctccaaaaaagcaataaaaaaaaaacaaactataataa

SEQ ID NO: 5614 - DNA, 1004 bp, Homo sapiens
gtaaagtgaaaacaaaagtagctggagttaggtcatttgattttatactctgtactcaagactgctcctctctgccgactacaacagattggagccatggctttggaacagaaccagtcaacagattattattatgaggaaaatgaaatgaatggcacttatgactacagtcaatatgaactgatctgtatcaaagaagatgtcagagaatttgcaaaagttttcctccctgtattcctcacaatagttttcgtcattggacttgcaggcaattccatggtagtggcaatttatgcctattacaagaaacagagaaccaaaacagatgtgtacatcctgaatttggctgtagcagatttactccttctattcactctgcctttttgggctgttaatgcagttcatgggtgggttttagggaaaataatgtgcaaaataacttcagccttgtacacactaaactttgtctctggaatgcagtttctggcttgtatcagcatagacagatatgtggcagtaactaaagtccccagccaatcaggagtgggaaaaccatgctggatcatctgtttctgtgtctggatggctgccatcttgctgagcataccccagctggttttttatacagtaaatgacaatgctaggtgcattcccattttcccccgctacctaggaacatcaatgaaagcattgattcaaatgctagagatctgcattggatttgtagtaccctttcttattatgggggtgtgctactttatcacagcaaggacactcatgaagatgccaaacattaaaatatctcgacccctaaaagttctgctcacagtcgttatagttttcattgtcactcaactgccttttgcttggatacatatgaatgatgctttcccctcaaataaaacatctgcattattctgaaactcaaatctcagacgccgtggttgcaacttataataaagaatgggttgggggaagggggagaaataaaagccaagaagagg

SEQ ID NO: 5615 - DNA, 1593 bp, Homo sapiens
gagcatggtttcacttttgcaaacatttatttatacccttcgagagaaaaacgtctcagctgtcacaggaagctgcttcggggggtgagcaaactttttaaaatgcagaaattatgatctacacccgtttcttaaaaggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatcta

SEQ ID NO: 5616 - DNA, 1796 bp, Homo sapiens
ctcagaaggccagaagacggctgtcaaaggtcacagggaaatcaaaggcggggtacagggccagagggaggaggaaacaacttcccggttgctttcagacgcttcagagatcctctggaggcctgggggagcttttgagtactttatttcagttggtccctgagctcggtgagtggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcccctgcaggagctcagcccagtgggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatcta

SEQ ID NO: 5617 - DNA, 1106 bp, Homo sapiens
tttatttatacccttcgagagaaaaacgtctcagctgtcacaggaagctgcttcgggggggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaa

SEQ ID NO: 5618 - DNA, 1642 bp, Homo sapiens
ctgctctggggaagtgggcacacgttaaagaaatgtttatttcagtcttctgaaatagggaattactctggctaaaatgtagctccagaaagggaaagtggggctgtatgaatccaggtccagtttgttgtttcctccaggataaggcagctgtcggaggggaaaatcatctcccatttctccacagggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatct

SEQ ID NO: 5619 - DNA, 713 bp, Homo sapiens
gtcacaggaagctgcttcggggggcaagtcctgtttctgctaaaagaagggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggaaactttttctcagccaggaggagggtgccctgtggcatcattacaagtgtcctggcatgggtaacagccattctggccactttgcctgaattcgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacat

SEQ ID NO: 5620 - DNA, 3316 bp, Homo sapiens
aaaaagccacagatctctggcggcggcaaggggacagcactgagctctgccgcctggctctagccgcctgcctggcccccgccgggactcttgcccaccctcagccatggctccgatatctctgtcgtggctgctccgcttggccaccttctgccatctgactgtcctgctggctggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccacctgccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcaagggagtgagttgatagcacagaccctgccctgtgggcccccaaatggaaatgggcagagcagagaccatccctgaaggccccgcccaggcttagtcactgagacagcccgggctctgcctcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccagggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaagacgctgtgctgccctgcccacctggcctctgcactcccctgctgggtgtggcgcagcatattcaggaagctcagggcctggctcaggtggggtcactctggcagctcagagagggtgggagtgggcccaatgcactttgttctggctcttccaggctgggagagccttccaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgtgaatcaa

SEQ ID NO: 5621 - DNA, 3151 bp, Homo sapiens
ggggcgggccgtgcttaccaggccgtggacttaaaccaggatgagagaacccctggaggcgtttaagttggcagacttggatttcaggaagagctctctggcttctgggtggagaatggccagtggggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaagtttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttcc

SEQ ID NO: 5622 - DNA, 3106 bp, Homo sapiens
aatactcgtctctggtaaagtctgagcaggacagggtggctgactggcagatccagaggttcccttggcagtccacgccaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaagtttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttcca

SEQ ID NO: 5623 - DNA, 559 bp, Homo sapiens
gcttttgtcctgtggccttctggccaaaggcagggaaaggtggccaaacactgagaccaagaacaaagaaagaaaactgctggtggacttcttccaccatgagcaggccaccaagcccgcagcactgcactgcagcccccagctctgtcctggggttgggggaggtgaggaggggcaaggtggggagcacacagagcacccgctgtcctcggaacaccacagcgactagaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccg

SEQ ID NO: 5624 - DNA, 699 bp, Homo sapiens
actttgaggagaagagctgtgtgtgccccagtgtggtccagtgagtactctgggctccctctcgtgggcagggaagctgagggccccatgagctctcccagcttcctgaaggctccccattaatgagagctgactgtgctgtgctttgctgactgcagggcctgctccctgccccccacctccaggttggggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgt

SEQ ID NO: 5625 - DNA, 3040 bp, Homo sapiens
atggcaagtgggaaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaagtttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttcca

SEQ ID NO: 5626 - DNA, 3255 bp, Homo sapiens
gcttttgtcctgtggccttctggccaaaggcagggaaaggtggccaaacactgagaccaagaacaaagaaagaaaactgctggtggacttcttccaccatgagcaggccaccaagcccgcagcactgcactgcagcccccagctctgtcctggggttgggggaggtgaggaggggcaaggtggggagcacacagagcacccgctgtcctcggaacaccacagcgactagaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaagtttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttcc

SEQ ID NO: 5627 - DNA, 3215 bp, Homo sapiens
actttgaggagaagagctgtgtgtgccccagtgtggtccagtgagtactctgggctccctctcgtgggcagggaagctgagggccccatgagctctcccagcttcctgaaggctccccattaatgagagctgactgtgctgtgctttgctgactgcagggcctgctccctgccccccacctccaggttggggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggcaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctggcactgctgtgctgtgcccaagttgtggtgctgacaaagcttggaagagcctgcaggtgctgctgcgtggcatagcccagacacagaagaggctggttcttacgatggcacccagtgagcactcccaagtctacagagtgatagccttccgtaacccaactctcctggactgccttgaatatcccctcccagtcaccttgtggcaagcccctgcccatctgggaaaataccccatcattcatgctactgccaacctggggagccagggctatgggagcagcttttttttcccccctagaaacgtttggaacaatctaaaagtttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttcc

SEQ ID NO: 5628 - DNA, 1097 bp, Homo sapiens
gccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcaggagcgtccgtggccactgaactgcgctgccagtgcttgcagaccctgcagggaattcaccccaagaacatccaaagtgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttatagaaaaaa

SEQ ID NO: 5629 - DNA, 1606 bp, Homo sapiens
agagaacaaaacagaaactcttggaagcaggaaaggtgcatgactcaaagagggaaattcctgtgccataaaaggattgctggtgtataaaatgctctatatatgccaattatcaatttcctttcatgttcagcatttctactccttccaagaagagcagcaaagctgaagtagcagcagcagcaccagcagcaacagcaaaaaacaaacatgagtgtgaagggcatggctatagccttggctgtgatattgtgtgctacagttgttcaaggcttccccatgttcaaaagaggacgctgtctttgcataggccctggggtaaaagcagtgaaagtggcagatattgagaaagcctccataatgtacccaagtaacaactgtgacaaaatagaagtgattattaccctgaaagaaaataaaggacaacgatgcctaaatcccaaatcgaagcaagcaaggcttataatcaaaaaagttgaaagaaagaatttttaaaaatatcaaaacatatgaagtcctggaaaagagcatctgaaaaacctagaacaagtttaactgtgactactgaaatgacaagaattctacagtaggaaactgagacttttctatggttttgtgactttcaacttttgtacagttatgtgaaggatgaaaggtgggtgaaaggaccaaaaacagaaatacagtcttcctgaatgaatgacaatcagaattccactgcccaaaggagtccaacaattaaatggatttctaggaaaagctaccttaagaaaggctggttaccatcggagtttacaaagtgctttcacgttcttacttgttgcattatacattcatgcatttctaggctagagaaccttctagatttgatgcttacaactattctgttgtgactatgagaacatttctgtctctagaagtcatctgtctgtattgatctttatgctatattactatctgtggttacggtggagacattgacattattactggagtcaagcccttataagtcaaaagcatctatgtgtcgtaaaacattcctcaaacattttttcatgcaaatacacacttctttccccaaacatcatgtagcacatcaatatgtagggagacattcttatgcatcatttggtttgttttataaccaattcattaaatgtaattcataaaatgtactatgaaaaaaattatacgctatgggatactggcaaaagtgcacatatttcataaccaaattagtagcaccagtcttaatttgatgtttttcaacttttattcattgagatgttttgaagcaattaggatatgtgtgtttactgtactttttgttttgatccgtttgtataaatgatagcaatatcttggacacatctgaaatacaaaatgtttttgtctaccaaagaaaaatgttgaaaaataagcaaatgtatacctagcaatcacttttactttttgtaattctgtctcttagaaaaatacataatctaatcaatttctttgttcatgcctatatactgtaaaatttaggtatactcaagactagtttaaagaatcaaagtcatttttttctctaataaactaccacaacctttcttttttaaaaaaa

SEQ ID NO: 5630 - DNA, 767 bp, Homo sapiens
aagacatcaagacttaaacgaaggaaaggattcaaaagaggagaggaaagtgcattttcatgctagaaaaaccatattatacaaatataaaaaatagggatctctcaggctcaccagatgaggggatgctgtgaaagaaggtaatcttcctcatgtgatgtcagagagtatagagccagaacaagtcacaatcctgaagacacgtctgaccccacacatctacaaagccagcagaaatcaggcagactaacttctacaataaggcagaaagtttgaaatttggaacacacggaaaggacttgcatttctactccttccaagaagagcagcaaagctgaagtagcagcagcagcaccagcagcaacagcaaaaaacaaacatgagtgtgaagggcatggctatagccttggctgtgatattgtgtgctacagttgttcaaggcttccccatgttcaaaagaggacgctgtctttgcataggccctggggtaaaagcagtgaaagtggcagatattgagaaagcctccataatgtacccaagtaacaactgtgacaaaatagaagtgattattaccctgaaagaaaataaaggacaacgatgcctaaatcccaaatcgaagcaagcaaggcttataatcaaaaaagttgaaagaaagaatttttaaaaatatcaaaacatatgaagtcctggaaaagagcatctgaaaaacctagaacaagtttaactgtgactactgaaatgacaagaattctacagtaggaaactga

SEQ ID NO: 5631 - DNA, 1971 bp, Homo sapiens
aatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtacc

SEQ ID NO: 5632 - DNA, 1753 bp, Homo sapiens
gcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaaaaaaaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgt

SEQ ID NO: 5633 - DNA, 2324 bp, Homo sapiens
ggtgcgtccgcgggtggctgccccgcaggtgcgcgcggccggggctggcggcgactctctccaccgggccgcccgggaggctcatgcagcgcggctgggtcccgcggcgcccggatcggggaagtgaaagtgcctcggaggaggagggccggtccggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgagcgcacggtcggggcacagcagggccggggggtgcagctggctcgcgcctcctctccggccgccgtctcctccggtccccggcgaaagccattgagacaccagctggacgtcacgcgccggagcatgtctgggagtcagagcgaggtggctccatccccgcagagtccgcggagccccgagatgggacgggacttgcggcccgggtcccgcgtgctcctgctcctgcttctgctcctgctggtgtacctgactcagccaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggttccagctcctttcctggagcgtgtgtgggggcaacaaggacccatgggttcaggaattgatgagctgtcttgatctcaaagaatgtggacatgcttactcggggattgtggcccaccagaagcatttacttcctaccagccccccaatttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagctgggcctgaggctggggagaaccagaagcagccggaaaaaaatgctggtcccacagccaggacatcagccacagtgccagtcctgtgcctcctggccatcatcttcatcctcaccgcagccctttcctatgtgctgtgcaagaggaggagggggcagtcaccgcagtcctctccagatctgccggttcattatatacctgtggcacctgactctaatacctgagccaagaatggaagcttgtgaggagacggactctatgttgcccaggctgttatggaactcctgagtcaagtgatcctcccaccttggcctctgaaggtgcgaggattataggcgtcacctaccacatccagcctacacgtatttgttaatatctaacataggactaaccagccactgccctctcttaggcccctcatttaaaaacggttatactataaaatctgcttttcacactgggtgataataacttggacaaattctatgtgtattttgttttgttttgctttgctttgttttgagacggagtctcgctctgtcatccaggctggagtgcagtggcatgatctcggctcactgcaacccccatctcccaggttcaagcgattctcctgcctcctcctgagtagctgggactacaggtgctcaccaccacacccggctaattttttgtatttttagtagagacggggtttcaccatgttgaccaggctggtctcgaactcctgacctggtgatctgcccacccaggcctcccaaagtgctgggattaaaggtgtgagccaccatgcctggccctatgtgtgttttttaactactaaaaattatttttgtaatgattgagtcttctttatggaaacaactggcctcagcccttgcgcccttactgtgattcctggcttcattttttgctgatggttccccctcgtcccaaatctctctcccagtacaccagttgttcctcccccacctcagccctctcctgcatcctcctgtacccgcagcgaaggcctgggctttcccaccctccctccttagcaggtgccgtgctgggacaccatacgggttggtttcacctcctcagtcccttgcctaccccagtgagagtctgatcttgtttttattgttattgcttttattattattgcttttattatcattaaaactctagttcttgttttgtctctccgaa

SEQ ID NO: 5634 - DNA, 1668 bp, Homo sapiens
tccgcgggtggctgccccgcaggtgcgcgcggccggggctggcggcgactctctccaccgggccgcccgggaggctcatgcagcgcggctgggtcccgcggcgcccggatcggggaagtgaaagtgcctcggaggaggagggccggtccggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgagcgcacggtcggggcacagcagggccggggggtgcagctggctcgcgcctcctctccggccgccgtctcctccggtccccggcgaaagccattgagacaccagctggacgtcacgcgccggagcatgtctgggagtcagagcgaggtggctccatccccgcagagtccgcggagccccgagatgggacgggacttgcggcccgggtcccgcgtgctcctgctcctgcttctgctcctgctggtgtacctgactcagccaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggttccagctcctttcctggagcgtgtgtgggggcaacaaggacccatgggttcaggaattgatgagctgtcttgatctcaaagaatgtggacatgcttactcggggattgtggcccaccagaagcatttacttcctaccagccccccaatttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagctgggcctgaggctggggagaaccagaagcagccggaaaaaaatgctggtcccacagccaggacatcagccacagtgccagtcctgtgcctcctggccatcatcttcatcctcaccgcagccctttcctatgtgctgtgcaagaggaggagggggcagtcaccgcagtcctctccagatctgccggttcattatatacctgtggcacctgactctaatacctgagccaagaatggaagcttgtgagggtaaactgtggcttattcttacaaaaagtgtaataaaggagactgacccctgacaacatggtaggcactgtatacatacttgtttttgttttttgttttttagagacggactctatgttgcccaggctgttatggaactcctgagtcaagtgatcctcccaccttggcctctgaaggtgcgaggattataggcgtcacctaccacatccagcctacacgtatttgttaatatctaacataggactaaccagccactgccctctcttaggcccctcatttaaaaacggttatactata

SEQ ID NO: 5635 - DNA, 852 bp, Homo sapiens
ctcgccctcaaatgggaacgctggcctgggactaaagcatagaccaccaggctgagtatcctgacctgagtcatccccagggatcaggagcctccagcagggaaccttccattatattcttcaagcaacttacagctgcaccgacagttgcgatgaaagttctaatctcttccctcctcctgttgctgccactaatgctgatgtccatggtctctagcagcctgaatccaggggtcgccagaggccacagggaccgaggccaggcttctaggagatggctccaggaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccacccctaaatcattccagtgctctcaaaaagcatgtttttcaagatcattttgtttgttgctctctctagtgtcttcttctctcgtcagtcttagcctgtgccctccccttacccaggcttaggcttaattacctgaaagattccaggaaactgtagcttcctagctagtgtcatttaaccttaaatgcaatcaggaaagtagcaaacagaagtcaataaatatttttaaatgtc

SEQ ID NO: 5636 - DNA, 1172 bp, Homo sapiens
gattcccataaagcacatggtctaatctgttacgtaacagcaagacagcgtcacctcacctgttctcgccctcaaatgggaacgctggcctgggactaaagcatagaccaccaggctgagtatcctgacctgagtcatccccagggatcaggagcctccagcagggaaccttccattatattcttcaagcaacttacagctgcaccgacagttgcgatgaaagttctaatctcttccctcctcctgttgctgccactaatgctgatgtccatggtctctagcagcctgaatccaggggtcgccagaggccacagggaccgaggccaggcttctaggagatggctccaggaaggcggccaagaatgtgagtgcaaagattggttcctgagagccccgagaagaaaattcatgacagtgtctgggctgccaaagaagcagtgcccctgtgatcatttcaagggcaatgtgaagaaaacaagacaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccacccctaaatcattccagtgctctcaaaaagcatgtttttcaagatcattttgtttgttgctctctctagtgtcttcttctctcgtcagtcttagcctgtgccctccccttacccaggcttaggcttaattacctgaaagattccaggaaactgtagcttcctagctagtgtcatttaaccttaaatgcaatcaggaaagtagcaaacagaagtcaataaatatttttaaatgtcacagatcaaaattgtttccttcaaatggggtctgccaattcacaaccagatgacccattttaccctattcactgcagactgaatccagattctacacatacttatccccaccaagaccctcactctgtctccattggcctacttgttcatctttcactcattcgacaaatctttctgaggtaagagcgaggtgggacaaaaaaaaaaaagcataccaatgaaccagacacggtcttattaaagataatataggttt

SEQ ID NO: 5637 - DNA, 1177 bp, Homo sapiens
cgggatcgatctggagctccgggaatttccctggcccgggactccgggctttccagccccaaccatgcataaaaggggttcgccgttctcggagagccacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggagcgcccctggccactgaactgcgctgccagtgcttgcagaccctgcagggaattcacctcaagaacatccaaagtgtgaaggtgaagtcccccggaccccactgcgcccaaaccgaagtcatagccacactcaagaatgggcagaaagcttgtctcaaccccgcatcgcccatggttaagaaaatcatcgaaaagatgctgaaaaatggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtgagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgtt

SEQ ID NO: 5638 - DNA, 1075 bp, Homo sapiens
acacagcccgggtcgcaggcacctccccgccagctctcccgcttctcgcacagcttcccgacgcgtctgctgagccccatggcccacgccacgctctccgccgcccccagcaatccccggctcctgcgggtggcgctgctgctcctgctcctggtggccgccagccggcgcgcagcaggagcgtccgtggtcactgaactgcgctgccagtgcttgcagacactgcagggaattcacctcaagaacatccaaagtgtgaatgtaaggtcccccggaccccactgcgcccaaaccgaagtcatagccacactcaagaatgggaagaaagcttgtctcaaccccgcatcccccatggttcagaaaatcatcgaaaagatactgaacaaggggagcaccaactgacaggagagaagtaagaagcttatcagcgtatcattgacacttcctgcagggtggtccctgcccttaccagagctgaaaatgaaaaagagaacagcagctttctagggacagctggaaaggacttaatgtgtttgactatttcttacgagggttctacttatttatgtatttatttttgaaagcttgtattttaatattttacatgctgttatttaaagatgtgagtgtgtttcatcaaacatagctcagtcctgattatttaattggaatatgatgggttttaaatgtgtcattaaactaatatttagtgggagaccataatgtgtcagccaccttgataaatgacagggtggggaactggagggtggggggattgaaatgcaagcaattagtggatcactgttagggtaagggaatgtatgtacacatctattttttatactttttttttaaaaaaagaatgtcagttgttatttattcaaattatctcacattatgtgttcaacatttttatgctgaagtttcccttagacattttatgtcttgcttgtagggcataatgccttgtttaatgtccattctgcagcgtttctctttcccttggaaaagagaatttatcattactgttacatttgtacaaatgacatgataataaaagttttatgaaaaaaaa

SEQ ID NO: 5639 - DNA, 2538 bp, Homo sapiens
ccatgagttcagggaatttccccagcatcccaaagcttgagtttcctgtcagtggggagagatgagtgtagataaaaggagtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgcgctgttggtgctgctgctgctgctgacgcagccagggcccatcgccagcgctggtcctgccgctgctgtgttgagagagctgcgttgcgtttgtttacagaccacgcaaggagttcatcccaaaatgatcagtaatctgcaagtgttcgccataggcccacagtgctccaaggtggaagtggtagcctccctgaagaacgggaaggaaatttgtcttgatccagaagccccttttctaaagaaagtcatccagaaaattttggacggtggaaacaaggaaaactgattaagagaaatgagcacgcatggaaaagtttcccagtcttcagcagagaagttttctggaggtctctgaacccagggaagacaagaaggaaagattttgttgttgtttgtttatttgtttttccagtagttagctttcttcctggattcctcactttgaagagtgtgaggaaaacctatgtttgccgcttaagctttcagctcagctaatgaagtgtttagcatagtacctctgctatttgctgttattttatctgctatgctattgaagttttggcaattgactatagtgtgagccaggaatcactggctgttaatctttcaaagtgtcttgaattgtaggtgactattatatttccaagaaatattccttaagatattaactgagaaggctgtggatttaatgtggaaatgatgtttcataagaattctgttgatggaaatacactgttatcttcacttttataagaaataggaaatattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatagatgaagaagctagaaaacaggcaaattcctgactgctagtttatatagaaatgtattcttttagtttttaaagtaaaggcaaacttaacaatgacttgtactctgaaagttttggaaacgtattcaaacaatttgaatataaatttatcatttagttataaaaatatatagcgacatcctcgaggccctagcatttctccttggataggggaccagagagagcttggaatgttaaaaacaaaacaaaacaaaaaaaaacaaggagaagttgtccaagggatgtcaattttttatccctctgtatgggttagattttccaaaatcataatttgaagaaggccagcatttatggtagaatatataattatatataaggtggccacgctggggcaagttccctccccactcacagctttggcccctttcacagagtagaacctgggttagaggattgcagaagacgagcgggagcggggagggcagggaagatgcctgtcgggtttttagcacagttcatttcactgggattttgaagcatttctgtctgaatgtaaagcctgttctagtcctggtgggacacactggggttgggggtgggggaagatgcggtaatgaaaccggttagtcagtgttgtcttaatatccttgataatgctgtaaagtttatttttacaaatatttctgtttaagctatttcacctttgtttggaaatccttcccttttaaagagaaaatgtgacacttgtgaaaaggcttgtaggaaagctcctccctttttttctttaaacctttaaatgacaaacctaggtaattaatggttgtgaatttctatttttgctttgtttttaatgaacatttgtctttcagaataggattctgtgataatatttaaatggcaaaaacaaaacataattttgtgcaattaacaaagctactgcaagaaaaataaaacatttcttggtaaaaacgtatgtatttatatattatatatttatatataatatatattatatatttagcattgctgagctttttagatgcctattgtgtatcttttaaaggttttgaccattttgttatgagtaattacatatatattacattcactatattaaaattgtacttttttactatgtgtctcattggttcatagtctttattttgtcctttgaataaacattaaaagatttctaaacttca

SEQ ID NO: 5640 - DNA, 2488 bp, Homo sapiens
tttattcatcaagtgccctctagctgttaagtcactctgatctctgactgcagctcctactgttggacacacctggccggtgcttcagttagatcaaaccattgctgaaactgaagaggacatgtcaaatattacagatccacagatgtgggattttgatgatctaaatttcactggcatgccacctgcagatgaagattacagcccctgtatgctagaaactgagacactcaacaagtatgttgtgatcatcgcctatgccctagtgttcctgctgagcctgctgggaaactccctggtgatgctggtcatcttatacagcagggtcggccgctccgtcactgatgtctacctgctgaacctggccttggccgacctactctttgccctgaccttgcccatctgggccgcctccaaggtgaatggctggatttttggcacattcctgtgcaaggtggtctcactcctgaaggaagtcaacttctacagtggcatcctgctgttggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcatgaggacccaggtgatccaggagagctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctcaactctgagtgttaagcgttgagccaccaagctggtggctctgtgtgctctgatccgagctcaggggggtggttttcccatctcaggtgtgttgcagtgtctgctggagacattgaggcaggcactgccaaaacatcaacctgccagctggccttgtgaggagctggaaacacatgttccccttgggggtggtggatgaacaaagagaaagagggtttggaagccagatctatgccacaagaaccccctttacccccatgaccaacatcgcagacacatgtgctggccacctgctgagccccaagtggaacgagacaagcagcccttagcccttcccctctgcagcttccaggctggcgtgcagcatcagcatccctagaaagccatgtgcagccaccagtccattgggcaggcagatgttcctaataaagcttctgttccgtgcttgtccctgtggaagtatcttggttgtgacagagtcaagggtgtgtgcagcattgttggctgttcctgcagtagaatgggggcagcacctcctaagaaggcacctctctgggttgaagggcagtgttccctggggctttaactcctgctagaacagtctcttgaggcacagaaactcctgttcatgcccatacccctggccaaggaagatccctttgtccacaagtaaaaggaaatgctcctccagggagtctcagcttcaccctgaggtgagcatcatcttctgggttaggccttgcctaggcatagccctgcctcaagctatgtgagctcaccagtccctccccaaatgctttccatgagttgcagttttttcctagtctgttttccctccttggagacagggccctgtcggtttattcactgtatgtccttggtgcctggagcctactaaatgctcaataaataatgatcacaggaa

SEQ ID NO: 5641 - DNA, 1402 bp, Homo sapiens
atttccgtttattcatcaagtgccctctagctgttaagtcactctgatctctgactgcagctcctactgttggacacacctggccggtgcttcagttagatcaaaccattgctgaaactgaagaggacatgtcaaatattacagatccacagatgtgggattttgatgatctaaatttcactggcatgccacctgcagatgaagattacagcccctgtatgctagaaactgagacactcaacaagtatgttgtgatcatcgcctatgccctagtgttcctgctgagcctgctgggaaactccctggtgatgctggtcatcttatacagcagggtcggccgctccgtcactgatgtctacctgctgaacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcatgaggacccaggtgatccaggagagctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctc

SEQ ID NO: 5642 - DNA, 869 bp, Homo sapiens
ccaaccacaagcaccaaagcagaggggcaggcagcacaccacccagcagccagagcaccagcccagccatggtccttgaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccaca

SEQ ID NO: 5643 - DNA, 1861 bp, Homo sapiens
caagcaccaaagcagaggggcaggcagcacaccacccagcagccagagcaccagcccagccatggtccttgaggggtccctgggccgatgggatcacgcagaagaatgcgagagaagcagcctttgagaagggaagtcactatcccagagcccaggctgagcggatggagttgaggaagtacggccctggaagactggcggggacagttataggaggagctgctcagagtaaatcacagactaaatcagactcaatcacaaaagagttcctgccaggcctttacacagccccttcctccccgttcccgccctcacaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccacagtctgacttccccgcattccaggctcctccctccctctgccggctctggctctccccaatatcctcgctcccgggactcactggcagccccagcaccaccaggtctcccgggaagccaccctcccagctctgaggactgcaccattgctgctccttagctgccaagccccatcctgccgcccgaggtggctgcctggagccccactgcccttctcatttggaaactaaaacttcatcttccccaagtgcggggagtacaaggcatggcgtagagggtgctgccccatgaagccacagcccaggcctccagctcagcagtgactgtggccatggtccccaagacctctatatttgctcttttatttttatgtctaaaatcctgcttaaaacttttcaataaacaagatcgtcaggacca

SEQ ID NO: 5644 - DNA, 1624 bp, Homo sapiens
ccaaccacaagcaccaaagcagaggggcaggcagcacaccacccagcagccagagcaccagcccagccatggtccttgaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccacagtctgacttccccgcattccaggctcctccctccctctgccggctctggctctccccaatatcctcgctcccgggactcactggcagccccagcaccaccaggtctcccgggaagccaccctcccagctctgaggactgcaccattgctgctccttagctgccaagccccatcctgccgcccgaggtggctgcctggagccccactgcccttctcatttggaaactaaaacttcatcttccccaagtgcggggagtacaaggcatggcgtagagggtgctgccccatgaagccacagcccaggcctccagctcagcagtgactgtggccatggtccccaagacctctatatttgctcttttatttttatgtctaaaatcctgcttaaaacttttcaataaacaagatcgtcaggacca

SEQ ID NO: 5645 - DNA, 4431 bp, Homo sapiens
aaaaaaaaaaagtgatgagttgtgaggcaggtcgcggccctactgcctcaggagacgatgcgcagctcatttgcttaaatttgcagctgacggctgccacctctctagaggcacctggcggggagcctctcaacataagacagtgaccagtctggtgactcacagccggcacagccatgaactacccgctaacgctggaaatggacctcgagaacctggaggacctgttctgggaactggacagattggacaactataacgacacctccctggtggaaaatcatctctgccctgccacagaggggcccctcatggcctccttcaaggccgtgttcgtgcccgtggcctacagcctcatcttcctcctgggcgtgatcggcaacgtcctggtgctggtgatcctggagcggcaccggcagacacgcagttccacggagaccttcctgttccacctggccgtggccgacctcctgctggtcttcatcttgccctttgccgtggccgagggctctgtgggctgggtcctggggaccttcctctgcaaaactgtgattgccctgcacaaagtcaacttctactgcagcagcctgctcctggcctgcatcgccgtggaccgctacctggccattgtccacgccgtccatgcctaccgccaccgccgcctcctctccatccacatcacctgtgggaccatctggctggtgggcttcctccttgccttgccagagattctcttcgccaaagtcagccaaggccatcacaacaactccctgccacgttgcaccttctcccaagagaaccaagcagaaacgcatgcctggttcacctcccgattcctctaccatgtggcgggattcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggcgtgaagttccgcagtgacctgtcgcggctcctgacgaagctgggctgtaccggccctgcctccctgtgccagctcttccctagctggcgcaggagcagtctctctgagtcagagaatgccacctctctcaccacgttctaggtcccagtgtccccttttattgctgcttttccttggggcaggcagtgatgctggatgctccttccaacaggagctgggatcctaagggctcaccgtggctaagagtgtcctaggagtatcctcatttggggtagctagaggaaccaacccccatttctagaacatccctgccagctcttctgccggccctggggctaggctggagcccagggagcggaaagcagctcaaaggcacagtgaaggctgtccttacccatctgcacccccctgggctgagagaacctcacgcacctcccatcctaatcatccaatgctcaagaaacaacttctacttctgcccttgccaacggagagcgcctgcccctcccagaacacactccatcagcttaggggctgctgacctccacagcttcccctctctcctcctgcccacctgtcaaacaaagccagaagctgagcaccaggggatgagtggaggttaaggctgaggaaaggccagctggcagcagagtgtggccttcggacaactcagtccctaaaaacacagacattctgccaggcccccaagcctgcagtcatcttgaccaagcaggaagctcagactggttgagttcaggtagctgcccctggctctgaccgaaacagcgctgggtccaccccatgtcaccggatcctgggtggtctgcaggcagggctgactctaggtgcccttggaggccagccagtgacctgaggaagcgtgaaggccgagaagcaagaaagaaacccgacagagggaagaaaagagctttcttcccgaaccccaaggagggagatggatcaatcaaacccggcggtcccctccgccaggcgagatggggtggggtggagaactcctagggtggctgggtccaggggatgggaggttgtgggcattgatggggaaggaggctggcttgtcccctcctcactcccttcccataagctatagacccgaggaaactcagagtcggaacggagaaaggtggactggaaggggcccgtgggagtcatctcaaccatcccctccgtggcatcaccttaggcagggaagtgtaagaaacacactgaggcagggaagtccccaggccccaggaagccgtgccctgcccccgtgaggatgtcactcagatggaaccgcaggaagctgctccgtgcttgtttgctcacctggggtgtgggaggcccgtccggcagttctgggtgctccctaccacctccccagcctttgatcaggtggggagtcagggacccctgcccttgtcccactcaagccaagcagccaagctccttgggaggccccactggggaaataacagctgtggctcacgtgagagtgtcttcacggcaggacaacgaggaagccctaagacgtcccttttttctctgagtatctcctcgcaagctgggtaatcgatgggggagtctgaagcagatgcaaagaggcaagaggctggattttgaattttctttttaataaaaaggcacctataaaacaggtcaatacagtacaggcagcacagagacccccggaacaagcctaaaaattgtttcaaaataaaaaccaagaagatgtcttcacatattgtatttatatatttatatttatatatatatttatataatggtacaaaatggctgggggtgtggccatggatggagggaagagtaggctggcctgtggcgtgggtgggaggagaggggacggagagggcactcggcccgctgcaatctgacccctctctcctcagggcaggaaacacagagtcagacagtttgggggggtcttgggccaggggtggagggctcaagggcacagggcccaggctgaggcagggcgggcaaagcgcctggcaggatgaagggcaagtggccccccaaacacagaggccctggccatggaccctgggaggtgaccggggtgagtcaggggcctgttgtcagccccagaggaagcgctggacctggccgatggtgggccgagaggacagcaccaggctgggagaagtggggcgagttccctttgtattacagctgccagtgcaagaccaggccctccaggccaggaaggctagggacgggtcctggtagaagacaccctgtctagaatggcccttggtcctggaggtggggcgcaaaaggcctcagccagggaactgccctgccacctcccgaggcaggaaaggaagtgagaaaaggagaagtttttttactcctggggccaaagtagggggacaaacacccagtcgtatatggcttcagctctgaccaaaggcggatagggagctctcctgggtaggagcagggagccaagggggaggcagtggctgtgcctgggtgggcacagacagatctggtacatggccctgagccctgggcagagggacaaccttgccggtgagtgggcaggcagagaggaggcggcaggatgctgtttccccgattccatcctcagggagtggagactggaggggaggtgcactgactcagatgaactgttctcccccttctttgataagaagtaggtggcagcagcctctggaaaagtcagggccctggaggttacctggcccagggctactacagccacaggccccagtggcaccatgccaccccttccatggctccactcaagggggccacacagccaccgcctcttcctcctttccttcatcccaaactgggacaaaagacttcaagttctggctaagatgtagcagcagcggatgcccgggcatccaaagtggaaagccagggccccgtgtcaccggtgtgggcaaacacacatgcacgtgcacacatgttctccctgaatcactcagcagcagacaggctgccgccctgggggtctcagccctgctagggctcaccaggtggaagcctaggtggtctgacctcagtttaggagtgggtcatttacgtcatcttaccatttggggacgagacaggaatggtatcccttagggacccagagacactgcaaacagtgggtggccatgtagggctgcatgtccctgggtccaggggaatggagggagcaataacttgaagaaggggggaagggtttcttttatccttttttttttgtgtgacttctatcaaaacacagaaatacagc

SEQ ID NO: 5646 - DNA, 1962 bp, Homo sapiens
gaagtagaggcagaccttgcttcatgagcaagctcatctctggaacaaactggcaaagcatctctgctggtgttcatcagaacagacaccatggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttataggccttgccagggtttcgagaagctgctctggaatttgcaagtcatggctgtgccctcttgatgtggtgaggcaggctttgtttatagcttgcgcattctcatggagaagttatcagacactctggctggtttggaatgcttcttctcaggcatgaacatgtactgttctcttcttgaacactcatgctgaaagcccaagtagggggtctaaaatttttaaggactttccttcctccatctccaagaatgctgaaaccaagggggatgacatgtgactcctatgatctcaggttctccttgattgggactggggctgaaggttgaagaggtgagcacggccaacaaagctgttgatggtaggtggcacactgggtgcccaagctcagaaggctcttctgactactgggcaaagagtgtagatcagagcagcagtgaaaacaagtgctggcaccaccaggcacctcacagaaatgagatcaggctctgcctcaccttggggcttgacttttgtataggtagatgttcagattgctttgattaatccagaataactagcaccagggactatgaatgggcaaaactgaattataagaggctgataattccagtggtccatggaatgcttgaaaaatgtgcaaaacagcgtttaagactgtaatgaatctaagcagcatttctgaagtggactctttggtggctttgcattttaaaaatgaaattttccaatgtctgccacacaaacgtatgtaaatgtatatacccacacacatacacacatatgtcatatattactagcatatgagtttcatagctaagaaataaaactgttaaagtctccaaact

SEQ ID NO: 5647 - DNA, 2242 bp, Homo sapiens
gtcaacccctgtacgcggtttccttctcctgctctcctgcttatagaacaattgttcctccagaacaattcctctcagccatagtggctctgctcccaccagatgatctctcagctcatcctggtgacttgcaggggtacaggtctgccggctatgttgcccaggctggcctcaaactcctggcttcaatgatcctctcatcttagcctcttgagtactgggactataagtgcccactgccacgcctggctggttaggctacttttctgtggatcacagcccatcatccaccaatgccttgccaacaactgtaaatgtctcatccctgaatcctggaactgataacagctctgccaggtcttcaggtgttcatcagaacagacaccatggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttataggccttgccagggtttcgagaagctgctctggaatttgcaagtcatggctgtgccctcttgatgtggtgaggcaggctttgtttatagcttgcgcattctcatggagaagttatcagacactctggctggtttggaatgcttcttctcaggcatgaacatgtactgttctcttcttgaacactcatgctgaaagcccaagtagggggtctaaaatttttaaggactttccttcctccatctccaagaatgctgaaaccaagggggatgacatgtgactcctatgatctcaggttctccttgattgggactggggctgaaggttgaagaggtgagcacggccaacaaagctgttgatggtaggtggcacactgggtgcccaagctcagaaggctcttctgactactgggcaaagagtgtagatcagagcagcagtgaaaacaagtgctggcaccaccaggcacctcacagaaatgagatcaggctctgcctcaccttggggcttgacttttgtataggtagatgttcagattgctttgattaatccagaataactagcaccagggactatgaatgggcaaaactgaattataagaggctgataattccagtggtccatggaatgcttgaaaaatgtgcaaaacagcgtttaagactgtaatgaatctaagcagcatttctgaagtggactctttggtggctttgcattttaaaaatgaaattttccaatgtctgccacacaaacgtatgtaaatgtatatacccacacacatacacacatatgtcatatattactagcatatgagtttcatagctaagaaataaaactg

SEQ ID NO: 5648 - DNA, 1184 bp, Homo sapiens
agcatccttccttgctagagagaaagggcactttggtccctggaaagacagaggcaagcagcagcatcggagacactgctcccagtcaggactcaaagtcagcgacagaagtgtttctgagtggattaggaaaggtgttcatcagaacagacaccatggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttatag

SEQ ID NO: 5649 - DNA, 2805 bp, Homo sapiens
atttttattaagcagtcttagcccaaaggcagcatccttccttgctagagagaaagggcactttggtccctggaaagacagaggcaagcagcagcatcggagacactgctcccagtcaggactcaaagtcagcgacagaagtgtttctgagtggattaggaaaggtaacctcatcgtttatatgcacttgtctggtcaggcaatattttgactttgctggcagagattctgtccaaacacctgctcttcttcatacatcttctagaggtgctggccagacatggctccaggtcactggaaatgagctgctgcatgttgagtatctgcagtcctgtagcaagggcagacttggcactcatgggctgatgttgccgcagctgcccctgctcccacaccacaggttacatgatcccttgtcctgtccatggtctttggcagggtcacagggcagagggaagggtcagagagaagtgacatcttgaagggctggtgccctgggtaagaaaggttgcccatctggcatcccatttcaattgggttttctgcttgttaaatgaggcccctaagtcctaacctgccaatcacaggagctaaggcaaggttccgctttggggaaatctaccttttaagagacttcttgttcagaagtcttcaggaaatgaggctctgatggtagaatgccataaactgtgttaactgatgaaggggaaagtttagttgggaagtgaggagaaccacccaatgctttaaccatgaagccagctcagccaaagtgctgggcagtcgtgggcttttctatgctttgtttccccattagtagcctttgaaaatctatgcaattgaggggaagtaaaggcaggaaggactacctacccaggcagagcagtcttgccatccccaaacacctgtggtctccaggagtctccttgataggagagccccctggtaggggcacttgctttagctttcacaatttattaggaaatggggctcaggatgggtgggcaactgtggtgaggcagggggagatgaaaacaggcatgttccattgatgagctcatattatcagtgggctcaaccatccatcatcagtgttgctcttccaaacagcactgtgcccacctggcagcaaagcgacttttggtttcaaaataattgagcacaggattttatggaatgtgcttaggggtcagttatgagttgtctcccagatgggtgagatcctgagaattttcaggctaatggagagtcctcatcctgtctgagcaatttcccctcagaattggttatcttcaatatactggactgtgctgtttctacacatcccagtgggtgggtttagaagatgactatttgccccctaaatgtggtcaatgggatagcaggaagacaaagaatgccatcctcagccccaaatataattcctgggttctgactcacaggtgttcatcagaacagacaccatggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttataggccttgccagggtttcgagaagctgctctggaatttgcaagtcatggctgtgccctcttgatgtggtgaggcaggctttgtttatagcttgcgcattctcatggagaagttatcagacactctggctggtttggaatgcttcttctcaggcatgaacatgtactgttctcttcttgaacactcatgctgaaagcccaagtagggggtctaaaatttttaaggactttccttcctccatctccaagaatgctgaaaccaagggggatgacatgtgactcctatgatctcaggttctccttgattgggactgggg

SEQ ID NO: 5650 - DNA, 2203 bp, Homo sapiens
acacttgtgcaggaaacaacagactagtgaggtttacaagaggggggtgtgtgtgtgtgtgtgtctgcctgtgggatgggggtggcacgggggagagagagatgtgggttacaaagctgccatctagaggctagaggctcctttctgcagtgtatataatgcaagtctgcagccagcagagctcacagttgttgcaaagtgctcagcactaagggagccagcgcacagcacagccaggaaggcgagcgagcccagccagcccagccagcccagccagcccggaggtcatttgattgcccgcctcagaacgatggatctgcatctcttcgactactcagagccagggaacttctcggacatcagctggccatgcaacagcagcgactgcatcgtggtggacacggtgatgtgtcccaacatgcccaacaaaagcgtcctgctctacacgctctccttcatttacattttcatcttcgtcatcggcatgattgccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcggcagcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcggcatggagctggtctccgttgtcttgggctttgccgttcccttctccattatcgctgtcttctacttcctgctggccagagccatctcggcgtccagtgaccaggagaagcacagcagccggaagatcatcttctcctacgtggtggtcttccttgtctgctggctgccctaccacgtggcggtgctgctggacatcttctccatcctgcactacatccctttcacctgccggctggagcacgccctcttcacggccctgcatgtcacacagtgcctgtcgctggtgcactgctgcgtcaaccctgtcctctacagcttcatcaatcgcaactacaggtacgagctgatgaaggccttcatcttcaagtactcggccaaaacagggctcaccaagctcatcgatgcctccagagtctcagagacggagtactctgccttggagcagagcaccaaatgatctgccctggagaggctctgggacgggtttacttgtttttgaacagggtgatgggccctatggttttctagagcaaagcaaagtagcttcgggtcttgatgcttgagtagagtgaagaggggagcacgtgccccctgcatccattctctctttctcttgatgacgcagctgtcatttggctgtgcgtgctgacagttttgcaacaggcagagctgtgtcgcacagcagtgctgtgcgtcagagccagctgaggacaggcttgcctggacttctgtaagataggattttctgtgtttcctgaattttttatatggtgatttgtatttaaattttaagactttattttctcactattggtgtaccttataaatgtatttgaaagttaaatatattttaaatattgtttgggaggcatagtgctgacatatattcagagtgttgtagttttaaggttagcgtgacttcagttttgactaaggatgacactaattgttagctgttttgaaattatatatatataaatatatataaatatataaatatatgccagtcttggctgaaatgttttatttaccatagttttatatctgtgtggtgttttgtaccggcacgggatatggaacgaaaactgctttgtaatgcagtttgtgacattaatagtattgtaaagttacattttaaaataaacaaaaaactgttctggactgcaaatctgcacacacaacgaacagttgcatttcagagagttctctcaatttgtaagttatttttttttaataaagatttttgtttcctaaaaatgca

SEQ ID NO: 5651 - DNA, 713 bp, Homo sapiens
ggtgaccccggggccagaattctcgcaggcgcctgggccgggtgcccggccgtgcgtcatttgattgcccgcctcagaacgatggatctgcatctcttcgactactcagagccagggaacttctcggacatcagctggccatgcaacagcagcgactgcatcgtggtggacacggtgatgtgtcccaacatgcccaacaaaagcgtcctgctctacacgctctccttcatttacattttcatcttcgtcatcggcatgattgccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcggcagcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcgg

SEQ ID NO: 5652 - DNA, 2910 bp, Homo sapiens
tattgcccacagagcctgttggtgacctgcacacaggagccctccagtcagtactgattgaattactcaaggctgcctctctgcaaagttgagcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagagcctgctccttgctaccatagtatgggctgtgtccctggccgtctccatccctgatatggtctttgtacagacacatgaaaatcccaagggtgtgtggaactgccacgcagatttcggcgggcatgggaccatttggaagctcttcctccgcttccagcagaacctcctagggtttctccttccactccttgccatgatcttcttctactcccgtattggttgtgtcttggtgaggctgaggcccgcaggccagggccgggctttaaaaatagctgcagccttggtggtggccttcttcgtgctatggttcccatacaatctcaccttgtttctgcatacgctgttggacctgcaagtattcgggaactgtgaggtcagccagcatctagactacgcactccaggtaacagagagcatcgccttccttcactgctgcttttcccccatcctgtatgccttctccagtcaccgcttccgccagtacctgaaggctttcctggctgccgtgcttggatggcacctggcacctggcactgcccaggcctcattatccagctgttctgagagcagcatacttactgcccaagaggaaatgactggcatgaatgaccttggagagaggcagtctgagaactaccctaacaaggaggatgtggggaataaatcagcctgagtgaccaaattttggtctggtgggaacagatgggaaccagctcaattgggtgtccactcaaagtgctctctccaggggcctcagtgactgtgttgctaaacccagtggtcagttctcagttctcagccatcagcagcatttgctcgccccgccttcttcctccactttcttcacttgcttccaggataccacgctttcttttctgaattgctacaatctttcttccttccttccttgcttccttccttccttccttccctctctccctccctccctccctcgcttcttcccttcctcctttcctcccttcctactttccttccttccttctgacagggtcttgctctattgctctgtcacccaggctggaatgcagtggcgagatctccgctcactgtagcctcctccccctgggttgaagcaattctcatgcctcagcctcccaagtagccaggactataggcacctgccaccatgcctggctaatttttgtattttttttctttctttctttcttttcttttttttttttttttgagacggagtctcactcttgttgcccaggctggacaacaatggcgcgatctcggctcactgcaacctccacctcccggattcaagcgattctcctgcctcagcctcctgagtagctggaactacatgcgcgtgccaccacgcacagctaatttttataattttagtagagatggggtttcactgcgttggccaggatgatctcgatctcttgaccttgggatccacccgccttggcctcccaaagtgctgggattacaggtgtgagccaccatgcctggccctaatttttgtgtttttattagaaacagagtttcaccatgttggccaggctggagaattgctgtaatagttttccaactggcccctgtccttcctctctcttgctctcctcccatctcatctgcacctagcagccagagtgatcctgatactctcggcctttacttccgcctccctcagagcagcagcctgtcaaaacaccagattacaacaaatttagtttaaaggtctcaattagcgttattggcaattctagaatcaggcaacagactcattgaatcaggaacagattcactccataaaatacagagagtgctgcaatgagctgggtagaagaggttagttttatagacaggaaggggctgtcaaaggcagaaagaaatgaagaacaaaaaaaaagattgatttttttttttttgagacaggatctcactctgtcatccaggctgaagtccaatcccacaatcatggctcactgcagccaccacctcctgagctcaagtgatcctcccatctaagcccccaagtagctaggactacaggagcacaccaccacacctggctaatttttgtattttttgtggagacagggtctcagtatgttacccaggttggactggaaacccttggctcaagcaatttgcctgcctcagcctcccaaagtgctgggattacaggcgtgagccactgcacagggccagattcatcatttcaaagttactttctatatgcggccggaacagggtggttgacatcagttttcttcaggttactttttaataatgattaaaacggggaacttcattatc

SEQ ID NO: 5653 - DNA, 2956 bp, Homo sapiens
acagtacgggatcctttctggaatggaggtcttatgagctgctattgaacacggcagagcctgttggtgacctgcacacaggagccctccagtcagtactgattgaattactcaaggctgcctctctgcaaagttgagcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagagcctgctccttgctaccatagtatgggctgtgtccctggccgtctccatccctgatatggtctttgtacagacacatgaaaatcccaagggtgtgtggaactgccacgcagatttcggcgggcatgggaccatttggaagctcttcctccgcttccagcagaacctcctagggtttctccttccactccttgccatgatcttcttctactcccgtattggttgtgtcttggtgaggctgaggcccgcaggccagggccgggctttaaaaatagctgcagccttggtggtggccttcttcgtgctatggttcccatacaatctcaccttgtttctgcatacgctgttggacctgcaagtattcgggaactgtgaggtcagccagcatctagactacgcactccaggtaacagagagcatcgccttccttcactgctgcttttcccccatcctgtatgccttctccagtcaccgcttccgccagtacctgaaggctttcctggctgccgtgcttggatggcacctggcacctggcactgcccaggcctcattatccagctgttctgagagcagcatacttactgcccaagaggaaatgactggcatgaatgaccttggagagaggcagtctgagaactaccctaacaaggaggatgtggggaataaatcagcctgagtgaccaaattttggtctggtgggaacagatgggaaccagctcaattgggtgtccactcaaagtgctctctccaggggcctcagtgactgtgttgctaaacccagtggtcagttctcagttctcagccatcagcagcatttgctcgccccgccttcttcctccactttcttcacttgcttccaggataccacgctttcttttctgaattgctacaatctttcttccttccttccttgcttccttccttccttccttccctctctccctccctccctccctcgcttcttcccttcctcctttcctcccttcctactttccttccttccttctgacagggtcttgctctattgctctgtcacccaggctggaatgcagtggcgagatctccgctcactgtagcctcctccccctgggttgaagcaattctcatgcctcagcctcccaagtagccaggactataggcacctgccaccatgcctggctaatttttgtattttttttctttctttctttcttttcttttttttttttttttgagacggagtctcactcttgttgcccaggctggacaacaatggcgcgatctcggctcactgcaacctccacctcccggattcaagcgattctcctgcctcagcctcctgagtagctggaactacatgcgcgtgccaccacgcacagctaatttttataattttagtagagatggggtttcactgcgttggccaggatgatctcgatctcttgaccttgggatccacccgccttggcctcccaaagtgctgggattacaggtgtgagccaccatgcctggccctaatttttgtgtttttattagaaacagagtttcaccatgttggccaggctggagaattgctgtaatagttttccaactggcccctgtccttcctctctcttgctctcctcccatctcatctgcacctagcagccagagtgatcctgatactctcggcctttacttccgcctccctcagagcagcagcctgtcaaaacaccagattacaacaaatttagtttaaaggtctcaattagcgttattggcaattctagaatcaggcaacagactcattgaatcaggaacagattcactccataaaatacagagagtgctgcaatgagctgggtagaagaggttagttttatagacaggaaggggctgtcaaaggcagaaagaaatgaagaacaaaaaaaaagattgatttttttttttttgagacaggatctcactctgtcatccaggctgaagtccaatcccacaatcatggctcactgcagccaccacctcctgagctcaagtgatcctcccatctaagcccccaagtagctaggactacaggagcacaccaccacacctggctaatttttgtattttttgtggagacagggtctcagtatgttacccaggttggactggaaacccttggctcaagcaatttgcctgcctcagcctcccaaagtgctgggattacaggcgtgagccactgcacagggccagattcatcatttcaaagttactttctatatgcggccggaacagggtggttgacatcagttttcttcaggttactttttaataatgattaaaacggggaacttcattatca

SEQ ID NO: 5654 - DNA, 2879 bp, Homo sapiens
ggatacagtacgggatcctttctggaatggaggtcttatgagctgctattgaacacggcagcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagagcctgctccttgctaccatagtatgggctgtgtccctggccgtctccatccctgatatggtctttgtacagacacatgaaaatcccaagggtgtgtggaactgccacgcagatttcggcgggcatgggaccatttggaagctcttcctccgcttccagcagaacctcctagggtttctccttccactccttgccatgatcttcttctactcccgtattggttgtgtcttggtgaggctgaggcccgcaggccagggccgggctttaaaaatagctgcagccttggtggtggccttcttcgtgctatggttcccatacaatctcaccttgtttctgcatacgctgttggacctgcaagtattcgggaactgtgaggtcagccagcatctagactacgcactccaggtaacagagagcatcgccttccttcactgctgcttttcccccatcctgtatgccttctccagtcaccgcttccgccagtacctgaaggctttcctggctgccgtgcttggatggcacctggcacctggcactgcccaggcctcattatccagctgttctgagagcagcatacttactgcccaagaggaaatgactggcatgaatgaccttggagagaggcagtctgagaactaccctaacaaggaggatgtggggaataaatcagcctgagtgaccaaattttggtctggtgggaacagatgggaaccagctcaattgggtgtccactcaaagtgctctctccaggggcctcagtgactgtgttgctaaacccagtggtcagttctcagttctcagccatcagcagcatttgctcgccccgccttcttcctccactttcttcacttgcttccaggataccacgctttcttttctgaattgctacaatctttcttccttccttccttgcttccttccttccttccttccctctctccctccctccctccctcgcttcttcccttcctcctttcctcccttcctactttccttccttccttctgacagggtcttgctctattgctctgtcacccaggctggaatgcagtggcgagatctccgctcactgtagcctcctccccctgggttgaagcaattctcatgcctcagcctcccaagtagccaggactataggcacctgccaccatgcctggctaatttttgtattttttttctttctttctttcttttcttttttttttttttttgagacggagtctcactcttgttgcccaggctggacaacaatggcgcgatctcggctcactgcaacctccacctcccggattcaagcgattctcctgcctcagcctcctgagtagctggaactacatgcgcgtgccaccacgcacagctaatttttataattttagtagagatggggtttcactgcgttggccaggatgatctcgatctcttgaccttgggatccacccgccttggcctcccaaagtgctgggattacaggtgtgagccaccatgcctggccctaatttttgtgtttttattagaaacagagtttcaccatgttggccaggctggagaattgctgtaatagttttccaactggcccctgtccttcctctctcttgctctcctcccatctcatctgcacctagcagccagagtgatcctgatactctcggcctttacttccgcctccctcagagcagcagcctgtcaaaacaccagattacaacaaatttagtttaaaggtctcaattagcgttattggcaattctagaatcaggcaacagactcattgaatcaggaacagattcactccataaaatacagagagtgctgcaatgagctgggtagaagaggttagttttatagacaggaaggggctgtcaaaggcagaaagaaatgaagaacaaaaaaaaagattgatttttttttttttgagacaggatctcactctgtcatccaggctgaagtccaatcccacaatcatggctcactgcagccaccacctcctgagctcaagtgatcctcccatctaagcccccaagtagctaggactacaggagcacaccaccacacctggctaatttttgtattttttgtggagacagggtctcagtatgttacccaggttggactggaaacccttggctcaagcaatttgcctgcctcagcctcccaaagtgctgggattacaggcgtgagccactgcacagggccagattcatcatttcaaagttactttctatatgcggccggaacagggtggttgacatcagttttcttcaggttactttttaataatgattaaaacggggaacttcattatca

SEQ ID NO: 5655 - DNA, 5283 bp, Homo sapiens
agtcccattcagggaagcagccccggcggccagcagggagctcaggacagagcaggctccctgggaagcctccgggtgataggggtgttccagctgcggcgctctgggggttcagagggggatcttgaatgaacaaatgaatgaactgctttctgggcaaacagccacagccagaggagcctgtgattggcagaaagaagccagggtgtgcaagtctccccaacagcctcgagtggcctgcagtcacagggaaccctcaggaagaccttccgggcagagaccagagggaaggtgtttctagctgtgtacagggactgattggctgaggactcacattggagagctgcagacaacataacggtgaatgagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtgtgcaaactgcagcgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttgatcctcactgtggaacccctcaatggactctctcaacccagggacacccaaggatatgtcttctgaagatcaaggcaagaacctctttagcatccaccaattttcactgcattttgcatgggatgaacagtgttttatgctgggaatctagggcctggaacccctttcttctagtggacagaacatgctgtgttccatacagccttggactagcaatttatgcttcttgggaggccagccttgactgactcaaagcaaaaaaggaagaattctcaaaagcattgccatgaactgggattggcatagggcggtgggattaagctgcctattgtgtgtgccccagaaatgacactctccaaggtccattcctggtgtgagcagtgagggggtcagagcaaacccagtgtgatgcagatcacacttggcccttgtatatatattatcagtagctggccagaaaaccctaccttcaagtcactgctctgtgttaaagtatgtggaaatgcataggtgatctgggagaggaaggtgacatatcagcccatgaactccataggccatgaatttggctttcggatcagctaggaagacagagaactggtcctgagaggtcctgtgggctctttgcaagggcaagacaagtgagggatgcaacgaggacttgagatttggcaaagaaatgagaaaggagaaaagaacctttaaaggatgcaggcatggagcagctcaccctagaacatcgcaggctgatggtgctttaggctggagctatttggggcgtcagggtggtgccagcccctgatctcaccttgcccctcttacctgggggtggggttgtggcaggcatcttcaccagcagccctcaccccatcacagggatttttttctgcctttcctaatccactcagctctggctggaggtgcttagaataaaacactggtggtggggcttctcattctggttaatttcctcaacgcctttggagacaggtccaaaatgcagctttgggaagcaactccggagagtcccctgggaagaagagtatgtccgaggactcagtcacttgagacagagtctggagctggactccttgaactgtgtttctgagctgcagacaccaaatacctcctggatacaggtgcctggcatggcttttctcatctaatactgacacgtccctgtggccacagagtgtcatagccccatttacaaatgacatagctgaggcccagatggggaaagtaacttgcccagcatcacacagctaatcagtggcagagttaagatctgaacctggctccgtctggctccagaaactctgttcttctatttggaatttatctgtggagattattctagtatattgatagcctacatttatttagcactttttatattatgcactttacatatgttttctcatttaatcattacagcaaccctgagttaggtatggttataacttcccttttacataggaggaatctgaggcttagagaggttaagtaacttgcccaaaggtacccagctagtctctgccggagcttggatttgaacttcagtttgcctggctcaaatgaggctgcagagttgggaaggacttaaaaagtttggagatttttgccataaatattgatttttctgcaaatgaggatgaacatcttaatggcctttaagaaactttgcaaatagttttcaaaaatgatgcaacatggcagagaaaatgcacttggcttccagctccctcaacagccattaacagcctcctaccgtggctcccacctcctatgtctccagagatcaaggcaatggggagggaaagctggcaggaggcagtcccttgtgggcctgaggccctttggctcctaagtgtccacattctgttctcttccaagtcccttcattgttaagctgattctccaacaagatgcaatgaacagatgcaatgtctaccccgcgctgggcgagttcccgaggccatgggctgtttggaatcacacttcattaagagacaaactgttccttcccttattgtgccttaatgcttatgacaaggcagctctgaattgatcccaagctggagcctctgaatgctttaaagagtttgaatatagacggtttgagagcaaaaagggagctttaaatattgctcagtggcccccatctcccctcttcccacatttactgaggcacgagatgggatgggacctgtcccgggtcacagcagcagtcgtcagcgccttggccctcctggcttgtaggatgctgcttttcctgggcttctggcagtccaggccaggatgggggagccaggaattcatgttgtcattggaaaagctgataaacaggagcacaattcaaaccggctgttttcctccttagagtctggcctccctctttctggctgctctgtgggtcttcctgttctgacttaggttcctgtcaagtacttaaatgcagccttaacatcccatacagtcttgtccccacagcttcatgtgaacatctccatgggtcatgcatatatcgtccctgcagtgtgcaaagtgtgctcacctgcactgctgcacaggcaaccaacatacttagtgcccagagccttctctctgggcccaggactcagtgatggggccttacttagccctgcctcctgggtggggtgggggagctgagggatcgtgaggacaagaggtagagggaaaagaaaagaagatggtgtttgaggataggggagggacaggagaggggacagaaaggtcccagagcatgatgatgaaggaaagggatctggcattcatgaagcacctacgatggttcaggcacaaacactgaaacctcaaattggccctggcagaaggggaccatcatagcaaggtggggggggggtgcagaaagtgagtttctgtttcaagaacagacttcactagttcagagttgcacagctagtgaggtatggagctgggctttgaatcaggtcagctgcctgaatgcccaacttcttcagcccttggaaggagagggtggggagaagaagaaggaaaagacaaggaagaaagaaagaagagagaaggggagaggaatggaagtccaaagagtgggaggaatttgatttcagaaccatctccagctgacccttgagccagcaaggacagggagaagggaagagcaagaacacgaagggcctcaagcaccgggatgcctttgccagccttagataattcccagagcgcacagagccctgcaggttcctgggtccttctccagagaagaggcacagagattctggcagcaaggttcagaaggggtgaggaaactgggcactgacaaagggaggggattggctcaaattcgaccccagagtcagctctggtggggttgggagcctggatgggtgggagaagatagaatccaatcgtgaaaaccataagggaccttcaaactcatcttgcccagatgtctcccatttcacagatgagggaactgaggttttgagagcttcccctgaggactctgcaaaacgaggtggtgtctggtttggatgaaagtggtcggtgattcctcaactcctgccctgcctccctctctcgttcctccctaacatgttatgctcttgttggggctgggatgccctaggcccaaggttaccaaatcctgggtttggaaaattgctgctgggggtggtatctaggaccagagaggaatctactatttctactgtgaaataattcagcagggggtcttcttacttcttccctttgaggacaaagtttctctcgaataaagagactgaagcaaga

SEQ ID NO: 5656 - DNA, 5283 bp, Homo sapiens; identical to SEQ ID NO: 5655

SEQ ID NO: 5657 - DNA, 5110 bp, Homo sapiens
aaagtggaacaggtgtctgtgattctgcccacggaaggagacatggaggaggaagaggctgaggggaagatggaagaaggagggaaggaaggagaaatctttgcttttgggtaatcaggtgtttctagctgtgtacagggactgattggctgaggactcacattggagagctgcagacaacataacggtgaatgagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtgtgcaaactgcagcgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttgatcctcactgtggaacccctcaatggactctctcaacccagggacacccaaggatatgtcttctgaagatcaaggcaagaacctctttagcatccaccaattttcactgcattttgcatgggatgaacagtgttttatgctgggaatctagggcctggaacccctttcttctagtggacagaacatgctgtgttccatacagccttggactagcaatttatgcttcttgggaggccagccttgactgactcaaagcaaaaaaggaagaattctcaaaagcattgccatgaactgggattggcatagggcggtgggattaagctgcctattgtgtgtgccccagaaatgacactctccaaggtccattcctggtgtgagcagtgagggggtcagagcaaacccagtgtgatgcagatcacacttggcccttgtatatatattatcagtagctggccagaaaaccctaccttcaagtcactgctctgtgttaaagtatgtggaaatgcataggtgatctgggagaggaaggtgacatatcagcccatgaactccataggccatgaatttggctttcggatcagctaggaagacagagaactggtcctgagaggtcctgtgggctctttgcaagggcaagacaagtgagggatgcaacgaggacttgagatttggcaaagaaatgagaaaggagaaaagaacctttaaaggatgcaggcatggagcagctcaccctagaacatcgcaggctgatggtgctttaggctggagctatttggggcgtcagggtggtgccagcccctgatctcaccttgcccctcttacctgggggtggggttgtggcaggcatcttcaccagcagccctcaccccatcacagggatttttttctgcctttcctaatccactcagctctggctggaggtgcttagaataaaacactggtggtggggcttctcattctggttaatttcctcaacgcctttggagacaggtccaaaatgcagctttgggaagcaactccggagagtcccctgggaagaagagtatgtccgaggactcagtcacttgagacagagtctggagctggactccttgaactgtgtttctgagctgcagacaccaaatacctcctggatacaggtgcctggcatggcttttctcatctaatactgacacgtccctgtggccacagagtgtcatagccccatttacaaatgacatagctgaggcccagatggggaaagtaacttgcccagcatcacacagctaatcagtggcagagttaagatctgaacctggctccgtctggctccagaaactctgttcttctatttggaatttatctgtggagattattctagtatattgatagcctacatttatttagcactttttatattatgcactttacatatgttttctcatttaatcattacagcaaccctgagttaggtatggttataacttcccttttacataggaggaatctgaggcttagagaggttaagtaacttgcccaaaggtacccagctagtctctgccggagcttggatttgaacttcagtttgcctggctcaaatgaggctgcagagttgggaaggacttaaaaagtttggagatttttgccataaatattgatttttctgcaaatgaggatgaacatcttaatggcctttaagaaactttgcaaatagttttcaaaaatgatgcaacatggcagagaaaatgcacttggcttccagctccctcaacagccattaacagcctcctaccgtggctcccacctcctatgtctccagagatcaaggcaatggggagggaaagctggcaggaggcagtcccttgtgggcctgaggccctttggctcctaagtgtccacattctgttctcttccaagtcccttcattgttaagctgattctccaacaagatgcaatgaacagatgcaatgtctaccccgcgctgggcgagttcccgaggccatgggctgtttggaatcacacttcattaagagacaaactgttccttcccttattgtgccttaatgcttatgacaaggcagctctgaattgatcccaagctggagcctctgaatgctttaaagagtttgaatatagacggtttgagagcaaaaagggagctttaaatattgctcagtggcccccatctcccctcttcccacatttactgaggcacgagatgggatgggacctgtcccgggtcacagcagcagtcgtcagcgccttggccctcctggcttgtaggatgctgcttttcctgggcttctggcagtccaggccaggatgggggagccaggaattcatgttgtcattggaaaagctgataaacaggagcacaattcaaaccggctgttttcctccttagagtctggcctccctctttctggctgctctgtgggtcttcctgttctgacttaggttcctgtcaagtacttaaatgcagccttaacatcccatacagtcttgtccccacagcttcatgtgaacatctccatgggtcatgcatatatcgtccctgcagtgtgcaaagtgtgctcacctgcactgctgcacaggcaaccaacatacttagtgcccagagccttctctctgggcccaggactcagtgatggggccttacttagccctgcctcctgggtggggtgggggagctgagggatcgtgaggacaagaggtagagggaaaagaaaagaagatggtgtttgaggataggggagggacaggagaggggacagaaaggtcccagagcatgatgatgaaggaaagggatctggcattcatgaagcacctacgatggttcaggcacaaacactgaaacctcaaattggccctggcagaaggggaccatcatagcaaggtggggggggggtgcagaaagtgagtttctgtttcaagaacagacttcactagttcagagttgcacagctagtgaggtatggagctgggctttgaatcaggtcagctgcctgaatgcccaacttcttcagcccttggaaggagagggtggggagaagaagaaggaaaagacaaggaagaaagaaagaagagagaaggggagaggaatggaagtccaaagagtgggaggaatttgatttcagaaccatctccagctgacccttgagccagcaaggacagggagaagggaagagcaagaacacgaagggcctcaagcaccgggatgcctttgccagccttagataattcccagagcgcacagagccctgcaggttcctgggtccttctccagagaagaggcacagagattctggcagcaaggttcagaaggggtgaggaaactgggcactgacaaagggaggggattggctcaaattcgaccccagagtcagctctggtggggttgggagcctggatgggtgggagaagatagaatccaatcgtgaaaaccataagggaccttcaaactcatcttgcccagatgtctcccatttcacagatgagggaactgaggttttgagagcttcccctgaggactctgcaaaacgaggtggtgtctggtttggatgaaagtggtcggtgattcctcaactcctgccctgcctccctctctcgttcctccctaacatgttatgctcttgttggggctgggatgccctaggcccaaggttaccaaatcctgggtttggaaaattgctgctgggggtggtatctaggaccagagaggaatctactatttctactgtgaaataattcagcagggggtcttcttacttcttccctttgaggacaaagtttctctcgaataaagagactgaagcaaga

SEQ ID NO: 5658 - DNA, 555 bp, Homo sapiens
gtatttctccaaagaaactctggaaggagacatgaggaactaacatagggaggtgtttctagctgtgtacagggactgattggctgaggactcacattggagagctgcagacaacataacggtgaatgagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctcc

SEQ ID NO: 5659 - DNA, 1893 bp, Homo sapiens
gtttctctggctgagttctgtcccagtcccattcagggaagcagccccggcggccagcagggagctcaggacagagcaggctccctgggaagcctccgggtgataggggtgttccagctgcggcgctctgggggttcagagggggatcttgaatgaacaaatgaatgaactgctttctgggcaaacagccacagccagaggagcctgtgattggcagaaagaagccagggtgtgcaagtctccccaacagcctcgagtggcctgcagtcacagggaaccctcaggaagaccttccgggcagagaccagagggaagcccatctctccagcagaactgcttggatttttctaccaggaggctcagggctctgcaacaatgatagcagaagctgatggcatctagagatctaggctgggactagcacagcatcacttctaccactttctgttggtcacagcaactcaccatgccagtgcagattcaaggggaggagaaatagagtccacttcttgatgggaggcgtgacatgtgtttctagctgtgtacagggactgattggctgaggactcacattggagagctgcagacaacataacggtgaatgagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtgtgcaaactgcagcgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttgatcctcactgtggaacccctcaatggactctctcaacccagggacacccaaggatatgtcttctgaagatcaaggcaagaacctctttagcatccaccaattttcactgcattttgcatgggatgaacagtgttttatgctgggaatctagggcctggaacccctttcttc

SEQ ID NO: 5660 - DNA, 632 bp, Homo sapiens
aaagtggaacaggtgtctgtgattctgcccacggaaggagacatggaggaggaagaggctgaggggaagatggaagaaggagggaaggaaggagaaatctttgcttttgggtaatcaggtgtttctagctgtgtacagggactgattggctgaggactcacattggagagctgcagacaacataacggtgaatgagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcc

SEQ ID NO: 5661 - DNA, 1890 bp, Homo sapiens
ccattcagggaagcagccccggcggccagcagggagctcaggacagagcaggctccctgggaagcctccgggtgataggggtgttccagctgcggcgctctgggggttcagagggggatcttgaatgaacaaatgaatgaactgctttctgggcaaacagccacagccagaggagcctgtgattggcagaaagaagccagggtgtgcaagtctccccaacagcctcgagtggcctgcagtcacagggaaccctcaggaagaccttccgggcagagaccagagggaagcccatctctccagcagaactgcttggatttttctaccaggaggctcagggctctgcaacaatgatagcagaagctgatggcatctagagatctaggctgggactagcacagcatcacttctaccactttctgttggtcacagcaactcaccatgccagtgcagattcaaggggaggagaaatagagtccacttcttgatgggaggcgtgacatagaatggaggatgaagattacaacacttccatcagttacggtgatgaataccctgattatttagactccattgtggttttggaggacttatcccccttggaagccagggtgaccaggatcttcctggtggtggtctacagcatcgtctgcttcctcgggattctgggcaatggtctggtgatcatcattgccaccttcaagatgaagaagacagtgaacatggtctggttcctcaacctggcagtggcagatttcctgttcaacgtcttcctcccaatccatatcacctatgccgccatggactaccactgggttttcgggacagccatgtgcaagatcagcaacttccttctcatccacaacatgttcaccagcgtcttcctgctgaccatcatcagctctgaccgctgcatctctgtgctcctccctgtctggtcccagaaccaccgcagcgttcgcctggcttacatggcctgcatggtcatctgggtcctggctttcttcttgagttccccatctctcgtcttccgggacacagccaacctgcatgggaaaatatcctgcttcaacaacttcagcctgtccacacctgggtcttcctcgtggcccactcactcccaaatggaccctgtggggtatagccggcacatggtggtgactgtcacccgcttcctctgtggcttcctggtcccagtcctcatcatcacagcttgctacctcaccatcgtgtgcaaactgcagcgcaaccgcctggccaagaccaagaagcccttcaagattattgtgaccatcatcattaccttcttcctctgctggtgcccctaccacacactcaacctcctagagctccaccacactgccatgcctggctctgtcttcagcctgggtttgcccctggccactgcccttgccattgccaacagctgcatgaaccccattctgtatgttttcatgggtcaggacttcaagaagttcaaggtggccctcttctctcgcctggtcaatgctctaagtgaagatacaggccactcttcctaccccagccatagaagctttaccaagatgtcatcaatgaatgagaggacttctatgaatgagagggagaccggcatgctttgatcctcactgtggaacccctcaatggactctctcaacccagggacacccaaggatatgtcttctgaagatcaaggcaagaacctctttagcatccaccaattttcactgcattttgcatgggatgaacagtgttttatgctgggaatctagggcctggaacccctttcttctagtggacagaacatgctgtgttccatacagccttggactagcaatttatgcttcttgggaggccagccttgactgactcaaagcaaaaaaggaagaattc

SEQ ID NO: 5662 - DNA, 2047 bp, Homo sapiens
agtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagc

SEQ ID NO: 5663 - DNA, 1761 bp, Homo sapiens
atcgcaagatggcgtctgcgaggccgcgggatgcggagtgagcgcgccccgccgggggctgtgcgaggctgctgctgctctccccgtcgccgccgccgccgccgccagtgcggcgccgcctctccgccagccactgcgccgcggccaagcctcctgcctcgcagcggtcccccgcgtcccggcctgcagcctccccgggcgccggcgcccccagcacgccccatcgggcaccccactctctccgaggtgtgggtgcggcgggctgatgaggtgatccctagcccgcctgggaggagcgcctggactcgcgggcggcggcgagcgcctttacaatggccctgaccctgtttgatacagatgaatatagacctcctgtttggaaatcttacttatatcagctacaacaggaagcccctcatcctcgaagaattacctgtacttgcgaggtggaaaacagaccaaagtattatggaagagagtttcatggcatgatctccagagaagcagccgaccagctcttgattgtggctgaggggagctacctcatccgggagagccagcggcagccagggacctacactttggctttaagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaagggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaag

SEQ ID NO: 5664 - DNA, 2447 bp, Homo sapiens
gccaagcctcctgcctcgcaggtacctcctcccgcgcgcacgctccgcgcctgatggcagcgacaagtgccggctcgcggagagctagcggggctccctgggcccggtgcgcccgacaataacgcgtgaataactttttcttgcagcggtcccccgcgtcccggcctgcagcctccccgggcgccggcgcccccagcacgccccatcgggcaccccactctctccgaggtgtgggtgcggcgggctgatgaggtgatccctagcccgcctgggaggagcgcctggactcgcgggcggcggcgagcgcctttacaatggccctgaccctgtttgatacagatgaatatagacctcctgtttggaaatcttacttatatcagctacaacaggaagcccctcatcctcgaagaattacctgtacttgcgaggtggaaaacagaccaaagtattatggaagagagtttcatggcatgatctccagagaagcagccgaccagctcttgattgtggctgaggggagctacctcatccgggagagccagcggcagccagggacctacactttggctttaagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaaggttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaata

SEQ ID NO: 5665 - DNA, 3530 bp, Homo sapiens
ttcttcctttgtgtgtgcgcgagcggagttggggcggagggagaagggggaggtcgctctgtctgtccgtctcccgccgcctctgcccggtctactcgaagtgcggcgggagaggcgggagcccaggagagggtgcgggagctggcggggcggctcggagctgccaggacgccctggtcccagccgcgcacaggggagcgtggacggcagaggggctcggcgggagccgagatccgcccgtcccggctgcccctcggcctccctctgctcccacctaccccctgacacccatagaaaagcgtgcaaaggcgcggagcgggacggaaaccacaaataaatagcggcggcggcagcgcgtcatctggtggagcaggaagtgcaggcagagtccggaggctggtgctttctgcgcgtccccaggactttgccatgggctgggggccgcggaggctgcgagcggccgggcgagggcagcggcggcggcgtccgcaccggggctgagcgagcagcgacgcgaggggcgcgcggagatggcagcgtccagcaactccagcctgtccggctcgtcggtgtcctccgatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttcctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacgtgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttaccctcttttcttcctggccaagccctctgaattcatctgttaatatcaaattgtatttttgccacatttctgtattggtgaaaagcgaatctgcagaataactgtcaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatta

SEQ ID NO: 5666 - DNA, 2832 bp, Homo sapiens
attgttccaggcgcacgtcggccttaagaaatagcacaaaacaggcccatccttattcagaagccgggccccctccatcactcaaactgggcctttcaggtcacatgccggaggctgctgcagacaggacccagctgcctcaaatctgccgcctaacataagctgcggttcgaaaatcctgacagcacagggcttcctgggctctgcagagcaaactggaaagagctgggatccaggcactatgttctctgaagaactgtggctggaaaatgagaaaaagtgtgctgtggttcggaagtctaagcagggcaggaaacgccaagaactgctggccgtagccttcggggtgaaggtgggtgtcaaaggcggctttctttggccccctctcaaactctttgcctgttcacagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttcctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacgtgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttaccctcttttcttcctggccaagccctctgaattcatctgttaatatcaaattgtatttttgccacatttctgtattggtgaaaagcgaatctgcagaataactgtcaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatt

SEQ ID NO: 5667 - DNA, 539 bp, Homo sapiens
gcgaggggcgcgcggagatggcagcgtccagcaactccagcctgtccggctcgtcggtgtcctccgtctattctgaacccagaagcccgagagagcttccaaaatatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccacccta

SEQ ID NO: 5668 - DNA, 825 bp, Homo sapiens
atgttctctgaagaactgtggctggaaaatgagaaaaagtgtgctgtggttcggaagtctaagcagggcaggaaacgccaagaactgctggccgtagccttcggggtgaaggtgggtgtcaaaggcggctttctttggccccctctcaaactctttgcctgttcacagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 5669 - DNA, 1195 bp, Homo sapiens
agcacagggcttcctgggctctgcagagcaaactggaaagagctgggatccaggcactatgttctctgaagaactgtggctggaaaatgagaaaaagtgtgctgtggttcggaagtctaagcagggcaggaaacgccaagaactgctggccgtagccttcggggtgaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttcctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatcttt

SEQ ID NO: 5670 - DNA, 2608 bp, Homo sapiens
actcgaagtgcggcgggagaggcgggagcccaggagagggtgcgggagctggcggggcggctcggagctgccaggacgccctggtcccagccgcgcacaggggagcgtggacggcagaggggctcggcgggagccgagatccgcccgtcccggctgcccctcggcctccctctgctcccacctaccccctgacacccatagaaaagcgtgcaaaggcgcggagcgggacggaaaccacaaataaatagcggcggcggcagcgcgtcatctggtggagcaggaagtgcaggcagagtccggaggctggtgctttctgcgcgtccccaggactttgccatgggctgggggccgcggaggctgcgagcggccgggcgagggcagcggcggcggcgtccgcaccggggctgagcgagcagcgacgcgaggggcgcgcggagatggcagcgtccagcaactccagcctgtccggctcgtcggtgtcctccgatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcagaaatcccaccaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttcctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacgtgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttaccctcttttcttcctggccaagccctctgaattcatctgttaatatcaaattgtatttttgccacatttctgtattggtgaaaagcgaatctgcagaataactgtcaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatt

SEQ ID NO: 5671 - DNA, 861 bp, Homo sapiens
atgttctctgaagaactgtggctggaaaatgagaaaaagtgtgctgtggttcggaagtctaagcagggcaggaaacgccaagaactgctggccgtagccttcggggtgaaggtgggtgtcaaaggcggctttctttggccccctctcaaactctttgcctgttcacagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 5672 - DNA, 1516 bp, Homo sapiens
gcgaggggcgcgcggagatggcagcgtccagcaactccagcctgtccggctcgtcggtgtcctccgtctattctgaacccagaagcccgagagagcttccaaaatatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagct

SEQ ID NO: 5673 - DNA, 975 bp, Homo sapiens
atggcagcgtccagcaactccagcctgtccggctcgtcggtgtcctccgatgctgaagaataccagcctcctatatggaaatcatacttatatcagttacagcaagaggcacctcgtcccaagagaatcatttgtcctcgggagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 5674 - DNA, 1632 bp, Homo sapiens
atgacccagacccacagggcaaaaagtgcgtcgtcgtgtcccaacctcctggtcccagaaacctggccgcatcaagtcagcgcttcccatgctggaagaagcaagcagccccagggtggaatcttaaaaattaatgaagagcatcggcggggtgccattcaggacttacttgcaagcccaggatttacatttggaaagcgagtggtgtttgattcccactgtttaaaaaggcaacacacgttcgctgatggtctacattccagctgcactagcaatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaa

SEQ ID NO: 5675 - DNA, 1853 bp, Homo sapiens
cttttcccttatcctccagcagccgagacaaacatgcaaacagcaacctctattccagtttgataaaacaaattctgtggagaagggtgcagaggagaggaattgacttagtcaaattagaggggtcagtggaaatgtcatatgagttgggccttgaaagctgagtagaatttttccggaaaacaaatggagaaaaagacatttcaggaagagagaagagcttaggtaaaggcctggagatggatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttcctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctgg

SEQ ID NO: 5676 - DNA, 1792 bp, Homo sapiens
agtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccatttctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgtggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctacttccccttcctaattccacagctgctcaataaagtacaagagcttaacagtg

SEQ ID NO: 5677 - DNA, 921 bp, Homo sapiens
gctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactatctgtgacttcctccgcggagccacagtccatagaatcctcggccagcaggtcccctatgccaccaagggcaaccagtgggtaggatacgacgaccaggaaagcgtcaaaagcaaggtgcagtacctgaaggacaggcagctggcgggcgccatggtatgggccctggacctggatgacttccagggctccttctgtggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgattaatggaaatgtttacagatccccaagcctggcaagggaatttcttcaactccctgccccccagccctccttatcaaaggacaccattttggcaagctctatcaccaaggagccaaacatcctacaagacacagtgaccatactaattataccccctgcaaagcccagcttgaaaccttcacttaggaacgtaatcgtgtcccctatcctactt

SEQ ID NO: 5678 - DNA, 1482 bp, Homo sapiens
cgggactggtgctgactgcaaccatgacaaagcttattctcctcacaggtcttgtccttatactgaatttgcagctcggaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcagatgaggaaactaaagtacagagaggatttaagcaacttgcccaagatcacacaactagtaggaatcataacttcctctgcagtttggccacagagtccattgcttctaagcattacactaggctgcccgttattactgagaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtc

SEQ ID NO: 5679 - DNA, 1622 bp, Homo sapiens
tctgggtcaaattgttctctatttagaagcctttgtgataaccacagaatcagaacatataaaaagctctgcgggactggtgctgactgcaaccatgacaaagcttattctcctcacaggtcttgtccttatactgaatttgcagctcggctctgcctaccagctgacatgctacttcaccaactgggcccagtaccggccaggcctggggcgcttcatgcctgacaacatcgacccctgcctctgtacccacctgatctacgcctttgctgggaggcagaacaacgagatcaccaccatcgaatggaatgatgtgactctctaccaagctttcaatggcctgaaaaataagaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtcaaaaca

SEQ ID NO: 5680 - DNA, 1214 bp, Homo sapiens
accatgacaaagcttattctcctcacaggtcttgtccttatactgaatttgcagctcggaacagccagctgaaaactctcctggccattggaggctggaacttcgggactgccccatgaggaaactaaagtacagagaggatttaagcaacttgcccaagatcacacaactagtaggaatcataacttcctctgcagtttggccacagagtccattgcttctaagcattacactaggctgcccgttattactgagaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacct

SEQ ID NO: 5681 - DNA, 1625 bp, Homo sapiens
gctttccagtctggtggtgaatcctccatagtctgaagcctttgtgataaccacagaatcagaacatataaaaagctctgcgggactggtgctgactgcaaccatgacaaagcttattctcctcacaggtcttgtccttatactgaatttgcagctcggctctgcctaccagctgacatgctacttcaccaactgggcccagtaccggccaggcctggggcgcttcatgcctgacaacatcgacccctgcctctgtacccacctgatctacgcctttgctgggaggcagaacaacgagatcaccaccatcgaatggaatgatgtgactctctaccaagctttcaatggcctgaaaaataagaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtc

SEQ ID NO: 5682 - DNA, 1354 bp, Homo sapiens
gaaacctcctcgtctgtgcacgaacaggtggccgactctggagcccaggctgttgctttccagtctggtggtgaatcctccatagtctggaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtc

SEQ ID NO: 5683 - DNA, 1320 bp, Homo sapiens
cttattctcctcacaggtcttgtccttatactgaatttgcagctcggaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtcaaaacatga

SEQ ID NO: 5684 - DNA, 1482 bp, Homo sapiens; identical to SEQ ID NO: 5678

SEQ ID NO: 5685 - DNA, 1188 bp, Homo sapiens
gaaacctcctcgtctgtgcacgaacaggtggccgactctggagcccaggctgttgctttccagtctggtggtgaatcctccatagtctggaacagccagctgaaaactctcctggccattggaggctggaacttcgggactgccccgaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtc

SEQ ID NO: 5686 - DNA, 977 bp, Homo sapiens
atgacaaagcttattctcctcacaggtcttgtccttatactgaatttgcagctcggaacagccagctgaaaactctcctggccattggaggctggaacttcgggactgccccgaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacatcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctgtcagagccaacggcctctaccccgtggcaaataacagaaatgccttctggc

SEQ ID NO: 5687 - DNA, 3082 bp, Homo sapiens
cgcccacccaggcggtaggaacccactccggcccgctagacctgctgctatgtcccggccgcagcttcgacgctggcgcctcgtctctagcccgccgagcggcgtcccgggtctagcgctgctggcgctgctggcgctgctggcgctgcggctcgcggccgggaccgactgcccatgcccggagcctgagctctgccgcccgattcgccaccatccagatttcgaggtctttgtgtttgatgttggacagaaaacttggaaatcttatgattggtcacagattacaactgtggcaacatttggaaaatatgactcagaacttatgtgctacgctcattcaaaaggagccagagtagtacttaaaggagatgtatccttaaaggatatcattgatcctgctttcagagcatcctggatagctcaaaaacttaatttggccaaaacacaatatatggatggaattaatatagatatagagcaagaagttaattgtttatcacctgaatatgatgcattaactgctttagtcaaagaaactacagactctttccatcgtgaaattgagggatcacaggtaacctttgatgtagcttggtctccaaagaacatagacagaagatgctataattatactggaatcgcagatgcttgtgacttcctctttgtgatgtcttatgatgaacaaagtcagatctggtcagaatgtattgcagcagccaatgctccctataatcagacattaactggatataatgactacatcaagatgagcattaatcctaagaaacttgtaatgggtgttccttggtatggttatgattatacctgcctgaatctgtctgaggatcatgtttgtaccattgcaaaagtccctttccggggggctccttgtagtgacgctgcaggacgtcaggtgccctacaaaacgatcatgaagcaaataaatagttctatttctggaaacctatgggataaagatcagcgggctccttattataactataaagatcctgctggccactttcatcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatactaaaaaaaaagaataaataaatgttttgattgtttgaatttgaaaaatacacacgaatgtcctcagtatccaggaacataaaggcaagaagcaagtcaacttacctattaaatattcctctattagatgtttcaacactataatttaattgggaaaaattgctttcagaattttattatgccatatttcccttcattatagtaaaatatatgctcacgaatcaatgctgatttttaaaatatgtataatctgaagtggaaattgtttgcttagagtttttaaaaacctagtctttgaaaagcagtttgtgctatacttttcccccaaccctccaataaatcttaaatttaaaacctacaatgtagtgtctcccctttaggttcatcaaactgatgaaaataatttttctgcttcctgactccatatagtatttatgttctctgaggtacttgaactaaatctttggacagtgagtgagaattaaaaagaatccagaagattaaatgtattcacaaaatagaagaatgtaacagtaatattttgaattggtaagttagaactacctaatattttccaactacattatttttatgaggctcatttgtaaaatttttaataataggaataacttgcagttgaacttgattctgttcactgtcacacttctaattattcatttcttcatttatggacatatataatttatttcttggctagcttgcttacatggttaaatttttctttctacatctgcaatgtatcttttttatttttattttttgtagagacagggtctcgctatgttgtccagatgggtctccaactcctgggctcaagcactcctcctgccttggcttcctaaagagctgggattacaggcatgagctgcattgtgcttttaatgatctaaagacactgattagcttctcaactagttctctttctaaaagatcaattttatacaaataagttttctaaatgtaataaagtctgttttctttctccagggaattaagaacaacattgtgctgcccttattagttcctaattacagattaaaaatctgtatctttgaactctagatttacataaatcctggcttccctgcacattttgcccctgtaaattggaatacatgatgattgaaccatctgttatgagaatattacatttcctatttacacaattgtttgtgacagagtaaaaaccattttcatagtatatgttggatcactgttgtcttcatatttctaaaataaatgaattaaaaaatttaaattcttagatgcttatctctatcatagctcagaatgcaacttcaatacccccattcttttatatttccagatttcttttaattaagatataatgaacaaattaagttaaatgaagtctgtattttcatgcaaatatattagtattcattaatatacatttattctttgcaaatagattttagttatattagctcttaaattgttaaataaattattattgaattttattattaaattattaaaatgaaaattataaaattagcactgtaaaataatatgtaaaggacttggaatgttaaaaataaccattcatcattttgctttatattacatctaatatttcctgaaacattttgtaatacccacatggaaagtggagaaagagaaaccttgtgctttttataaaacattgccaaggagaataatggttaaacaaatctgttcaaatacatatttaaatttttttacaaataaaagttttaaattaacatacc

SEQ ID NO: 5688 - DNA, 3172 bp, Homo sapiens
agcaagagcagaggcttaaggagctacactgggggaaggacaggggcaagcaggccaaggcctggccggggctcggggggagggaatatggagcaatcccggtcacagcagcgtgggggtgaacaaagctggtggggtagtgacccccagtaccagtatatgccctttgaacactgcaccagctacggactgccctctgagaatgggggcctccagcacaggctccggaaggatgcaggcccccgccacaacgtccaccccacacagatttatggccatcacaaagaacaattctcagacagggagcaggacatagggatgcccaagaagacaggctccagttctaccgtggacagcaaggatgaggatcactattctaaatgtcaagattgtatccaccgcctgggacaggtggtgagaagaaaattaggggaagacgggatctttctggtgcttctgggactgctgatggctctggtcagctggagcatggactacgtcagtgccaaaagccttcaggcctacaagtggtcctacgcgcagatgcagcccagccttcctctgcagttcctggtctgggtcaccttcccactagtcctcatcctcttcagcgccctcttctgccacctcatctctccccaggctgttggctctggaatccccgaaatgaagacaatacttcgtggggttgtcctgaaggaatacctcacaatgaaagcctttgtggccaaggttgtcgccctgactgcgggcctgggcagtggcatccccgtggggaaagagggccccttcgtccacattgccagcatctgtgctgctgtcctcagcaaattcatgtctgtgttctgcggggtatatgagcagccatactactactctgatatcctgacggtgggctgtgctgtgggagtcggctgttgttttgggacaccacttggaggagtgctatttagcatcgaggtcacctccacctactttgctgttcggaactactggagaggattctttgcagccacgttcagcgcctttgtgtttcgagtgctggcagtgtggaacaaggatgctgtcaccatcactgctctgttcagaaccaatttccgaatggatttcccctttgacctgaaggaactaccagcttttgctgccatcgggatttgctgtgggctcctgggagctgtatttgtgtatctgcatcgccaagtcatgctcggtgtccgaaagcacaaggccctcagccagtttcttgctaagcaccgcctgctgtatcctggaattgttacctttgtcattgcctcattcaccttcccaccaggaatgggtcaattcatggctggagagttgatgccccgcgaagccatcagtactttgtttgacaacaatacatgggtgaaacacgcgggtgatcctgagagcctgggccagtcagctgtgtggattcacccccgggtcaacgttgtcatcatcatctttctcttcttcgtcatgaagttctggatgtccatcgtggccaccactatgcccataccctgcggaggcttcatgcctgtgtttgtgctaggagctgcatttggaaggctggtaggagaaatcatggccatgctctttcctgatggtattttgtttgatgacatcatctacaagatcctacctgggggctatgcagtaattggagcagcagcgctgactggtgccgtttcccacacagtctccacagctgtgatttgcttcgaattaacgggtcagattgctcacatcctgcccatgatggtggctgttatcttggccaacatggtggcccagagcctgcagccctctctctatgacagcatcatccaggtcaagaagctaccctacttgcctgaccttggctggaaccagctcagcaaatataccatctttgttgaggacatcatggtacgtgatgtgaagtttgtttcagcttcttacacatatggggagttgcgaaccctgctccagaccaccacagtcaagactttaccactggttgactcaaaagattcaatgatcctgctgggctcggtggagcggtcggaactgcaggccctcctgcagcgccacctgtgtcctgagcgcaggctgcgcgcagcccaagagatggcgcggaagttgtcggagctgccttacgacgggaaggcgcggctggctggggaggggctccccggcgcgcctccaggccggcccgagtccttcgcctttgtggatgaggatgaggacgaagacctctctggcaagagcgagcttcctccttcccttgctctccacccctctactactgcccctctgtccccagaagagcccaatgggcctctgcctggccacaaacagcagccggaagcaccagagcctgcaggtcaaagaccctccatcttccagtccctgcttcactgcttgctgggcagagctcgccccacaaagaagaaaacaacccaggattccacagatttagtggataacatgtcacctgaagagattgaggcctgggagcaggagcagctgagccagcctgtctgttttgattcctgctgtattgaccagtctcccttccagctggtggagcagacaaccctgcacaagactcataccctgttttcactccttggcctccacctcgcttacgtgaccagcatggggaagctcaggggcgtcctggccctggaggagctacagaaggccattgaggggcacaccaagtctggggtgcagctccgccctccccttgccagcttccggaacacgacttcaactcgaaagagtaccggggcacctccatcttctgcagagaactggaacctgcctgaggacaggcctggggccactggaacaggggatgtgattgctgcctccccagagacccctgtgccatctccttccccagagccccctctctccctggccccaggcaaggtagagggcgagttggaggagctggagctggtggagagtccagggctggaagaggagctggccgacatcttgcagggccccagcctgcgatccacagacgaggaggatgaggatgaactgatcctttgaccccctcccacgacctcctcataaagaccgtggagaggcccagcctgagggtgaacttgtgtggggcagggtgcgtcctgaatgtggcgaggtcatgccaatgtcgtggcctcttcca

SEQ ID NO: 5689 - DNA, 3290 bp, Homo sapiens
gacgcgagcgggaggctgcgccagcggcgcccgccgggggcccgccgcactctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagttctggatgtctgcactggccaccaccatcccagttccctgtggggccttcatgcctgtctttgtcattggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctacccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccacttatatatagaa

SEQ ID NO: 5690 - DNA, 3160 bp, Homo sapiens
actctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctacccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccacttatat

SEQ ID NO: 5691 - DNA, 3635 bp, Homo sapiens
gtcacgcgtcgacgctggggcgtacctttcgggctcctgactcctgccgcttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggattgtcttggggatcatcacaaagaagaacatattagagcatctcgagcaactaaagcagcacgtcgaacccttggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctct

SEQ ID NO: 5692 - DNA, 3208 bp, Homo sapiens
acgcgtcgacgctggggcgtacctttcgggctcctgactcctgccgcttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagc

SEQ ID NO: 5693 - DNA, 3157 bp, Homo sapiens
ttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttgggagagtctcactatgttgtccaggctggtctccaactcctgggctcaagcaaccctcctgccttggcctcccaagtagctgagattacaggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacatt

SEQ ID NO: 5694 - DNA, 582 bp, Homo sapiens
agcgcgtggaaggcggcacgcagcggaggcggctgggaaggagcaataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttg

SEQ ID NO: 5695 - DNA, 563 bp, Homo sapiens
tttcgggctcctgactcctgccgcttctcttccccttccgtgggtcagggccggtccggtccggaacctgcagcccctttcccagtgttctagttcgcccgtgacccggaataatgagcaaggagggtgtgataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatc

SEQ ID NO: 5696 - DNA, 6692 bp, Homo sapiens
gtgacgtcacgcgtcgacgctggggcgtacctttcgggctcctgactcctgccgcttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagagggtcctggttcttatatcatgaactacataatgtacatcttctgggccttgagttttgcctttcttgcagtttccctggtaaaggtatttgctccatatgcctgtggctctggaattccagagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtgctatcagctgcctcagctgcaggggtttctgtagcttttggtgcaccaattggaggagttctttttagcctggaagaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaatagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatatctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagtgaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaatgtgtggtttggcctttaattatatctgtaacagtcctccctcttcactgctgccctacgcagtgtaggccgatatgcctggcacagggagccccaaaaaggtaataattataatgcttctctcaggttacaaagcatttctacactttgcaagcaaggagcaatagaagagtagatagatgctggattgacagcaggatgttcataccaccagcaatggtttagcgcccccatttgtcagtgaaagctgcaggtccacagaaaactgatttcatttcagctcactttcaaaagtgatttttttttttttcgcaagaaaaattacgctatttgcatgaaaagaggtaaaacgatttatttacatgtctttaaaaaatcaccttggacatttgctaatagaactgccaaaagagggtggtaagtaacaacctttgattaagatgtggtcttttactattaagcttttagtaaaaaggaacacactaaaa

SEQ ID NO: 5697 - DNA, 1082 bp, Homo sapiens
gccgcttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccagagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacggatcaacagcaaaaagaaagaatcagcatgggaaatgacaaaaagtttgtatgatgcgtggtcaggatggctagtagtaacactaacaggattggcatcaggggcactggccggattaatagacattgctgccgattggatgactgacctaaaggagggcatttgccttagtgcgttgtggtacaaccacgaacagtgctgttggggatctaatgaaacaacatttgaaaaaaaaaaaaaaaaaaaaaagaaagcc

SEQ ID NO: 5698 - DNA, 2418 bp, Homo sapiens
ccgcctcctggtgatgtcacggcgctcgcagccgtcgcgctgaagaaaggatgctcgaggatgctgtccaggtgggcggccgcgggcgcgatgcggcactgcaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaagatcaccagcaagagcaaggagtccatatgggagttcatcaagagcctgctggatgcctggtcgggatgggtggtgatgctgctcatcggcctgctggcgggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagagggtgccagtgcttacattctgaattacttaatgtacatcctatgggcgctgctgtttgcatttttggctgtctccctggtgcgtgtatttgcaccatatgcctgtggctctggcataccagagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgctttcagctgcagcggctgctggagtctctgttgcctttggtgcaccaattggaggcgtgcttttcagtctagaagaggtcagttactactttcccctgaagaccttgtggaggtcatttttcgcagccctggtggcggcctttacgctgagatccatcaatccctttgggaatagccgtctcgttctcttttatgtggaataccacacgccctggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataaagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaa

SEQ ID NO: 5699 - DNA, 6750 bp, Homo sapiens
atttgcctctggcaggaaaatgagcttgtcagtttctgcctccattagaccctcaacccaaaggagcaggagatttcggtagcgttttaactttatctcagaatctgaaagcggaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaagatcaccagcaagagcaaggagtccatatgggagttcatcaagagcctgctggatgcctggtcgggatgggtggtgatgctgctcatcggcctgctggcgggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagagggtgccagtgcttacattctgaattacttaatgtacatcctatgggcgctgctgtttgcatttttggctgtctccctggtgcgtgtatttgcaccatatgcctgtggctctggcataccagagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgctttcagctgcagcggctgctggagtctctgttgcctttggtgcaccaattggaggcgtgcttttcagtctagaagaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataaagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaagaaggatgaaacctttaaaaacaaaaacaaaaacatcaatgagtaggcattttatagctttaaccccgtatgagtttcaagctgtgtttcctaatgagtttgctactgctgtgggggcatgtgggtgggtaaatgatgtaaatgatgtgatctgtacaagtatgtggagcatgaatgctgactcaagaaacttttactccttctgctcaaggctgatgtttgtaacttatgaacacacgtgaagtgttgagtccaaaagacaaaggggcatcggcatgtcagcgtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatacagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccagcctgccataagcgtgctttcattttcaagtagcatatgcaagagtccaaacaggctacccaatgttactacttatttttcctctcaggtcttatcagatacggctgtggagaggatgaggcatatgcgttgtcagttggaatccctccaaatggattgcaagagaaatactaaattgattctaaatctgttccattatcttctctgtaggatgcaaaacatccagttgtaatgtataagcatgcacttcatactagcaatcacagcacaggaggacagcattaaattttatatagccaatttgggcactgggcatctttgtatttgaacttaacgacacatttactcttttagtcaggatttcggtcttttctgcgggaaggaattaagctatgtattaggtccaccatacgatctgtgtaagtaagattatcccacttgccctttctctttagtctttgtcccttccttttcactaagtgcccctcatccttttcaatctcattgtcactggatagtgctgtatcacttaggtgtgcattcggctgcaaataacagaaaacccagcaaacactgaagggctggataagaaccctgagagggggtactccaggactgtctccataacatcattgggatccccatcccgttgctatttctttttcaccgtttttaccttttgtcctctggcttattgcctcagagttgcaagatggttcctgaactgtcaggtatcatgtctgctttctaagtgggaagaggaagggagaggcaagcaactaggtacaatgtctatcaggaaagcaaagcttccccagagacgctcagcttgtatccattgactggaagtctgtcacgtggctccccctagccgcacactagtgtgggaaggaaaatattgagctaggcacattactctctgaacgaaattcatattatcttattaaggaagagtgttggtcttcaggaggggaagtttgctgtattggatgccatcatcgtgtccttgtcattgcccttccggttttcattcttgctaaacccctgtgaatgttcttctaaccttcctgttccccaccccttttctcagatttgacctagaattcccagcccaaatccataatttcttagctctaatacgaattttcatgttggacaaaaacctagctacaaatgggtttctatggaacttctaattaatgtgcaaaatacatattttctccaggttaagaaattttaagtcagatcatgctgacacaataagaaaatttgtttgtgtaattcattgacctcttccttccaaaataacatcaagtagccacctcagtgtgacaatatccagtcaatagtagagaatttaatccttggtcctataaaagaataaaattcattgtcgtatttatagcacgtaagccttgagtaacaggtcttaatgttagtgttggtgttgtggtttctgcggaacgtttacaagtgaagttggattctcctgggctttaaatccaaaaagtcttaatgaccgcttcatgtagttcccctcttattcccctgtggtctcctcagagccagcgtgtgctgggaaagagtattagtcatagcctggctttatagaatccaggaggtccttttagctgaaacaagtggcttcaaaagggaacatgaaacagtgaaaagatagccaaaggtcagtgaaaccacagcatttctttctaatctggctgaggccatgggggggaatgaggggaaattatgcttccgggccaaggtcaccgagggggaccttgggatttgtgtcctccccagtgcttagagtagagatacctgcaaattcatggcaaacagttggaagagttacttgactgaaacaacccaatcttactttctttcgtaagttgaacctctgatttattgtggggttcaggctctcctcaatagaaggccagagttggacaggtggactaaggtcaaggatgaggagtctgcagtggggactaccacagcaaactgccttccttccgtggagtcctaactcagccatgtggtccactcacccaggggcccgggggctcagacaaaccccatggggaacatgctgccatgctctgtctttcttgtaaacgtagttgggtagggatcccaagggtatttgctctctccaaatgcagaacttccatccactttatctggtgatctgatgaacagcatggggacgtggaggtgaaataagcatctttcagaataaggtttttttttttttcctcttccagaaccaaaggctttagacatttgtagaactttctggattccttctgaatcgggttttaacataaaaaaccatcaacacatcatgggaaaggagctctttcatgatatacatcacatgtttcttgctctcactgaggaaatgtgttgtacaaaagcaccaaataagggcaccctggaagtgacatgtgtgtttcttctaagtcgtttttagtgcatcccctgcgattgcatgatgctcatgtggcttttagggaaaggcagaatgtgctagaagtcgaagtcattcaatattcagtgcttactgttactttgaaccaggtaatctcagttctttattcagtccttcccaaagaccttacaaaggagatgtgtaaactgatagattttgagcctaataagtcacagaaatggaaaattttagagcagtttgtttcacttaggtgagaactgattactttaaattaccaacatgtgcaaattctacttagtattcattattagatgctaagctggaaaagatgagaaacccaaggagaactattgaattaccacataattgtaatattatgctttaattttgtatgggcagtgttctatcagactaagcttctagcctttgaaatgatttacatgaggagagagcctgtatatctgacttgggaaacattaagcagaccctattttcactggcgcggtaataactatttatttgctatcctagaggtgctgggaatgagcctacgtgcgactttgatgagatatattcacatttggtgttggaacgaccacatagcaacgtgttggtttttttttattgtaacactctgtgtaaacgttgacaccttattaaatattaaatgtctgaactctatttttaaaaataaaacaagcacagagtctgcaacaaacatgtaaa

SEQ ID NO: 5700 - DNA, 2227 bp, Homo sapiens
gctcgaggatgctgtccaggtgggcggccgcgggcgcgatgcggcactgcaggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagagggtgccagtgcttacattctgaattacttaatgtacatcctatgggcgctgctgtttgcatttttggctgtctccctggtgcgtgtatttgcaccatatgcctgtggctctggcataccagagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgctttcagctgcagcggctgctggagtctctgttgcctttggtgcaccaattggaggcgtgcttttcagtctagaagaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataaagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaag

SEQ ID NO: 5701 - DNA, 487 bp, Homo sapiens
ggcgcgatgcggcactgcaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaagatcaccagcaagagcaaggagtccatatgggagttcatcaagagcctgctggatgcctggtcgggatgggtggtgatgctgctcatcggcctgctggcgggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagaggtgctttcagctgcagcggctgct

SEQ ID NO: 5702 - DNA, 3177 bp, Homo sapiens
tgatgtgatatggctgcaagtgcctttgacccttttgtctcccttccataaactgaaatacctaagctgctccaacctcctttttgtcttttgtttcataaatcctttcccattgcacatcaactcctgtctctctttgtactgtcactctcatctgttgctttccattcacactgcctttagccactcatcattttgtgcctacaccacagaaacctctgaatgtaatggatgttcctaccagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattatatttgctttttaaaagatttttttaacttaaaaagtagttagccaatatgcaatcactgaaaactatgcaagagaaattccaaccgtcctgacctataacctgtaggaaaccgacgaaaaagtcactcttttgggatctaactgttgttactggaagacgaagtgtaaactaaggggctttgcttttcaaaccagagaaaggaaagccagaaggaaaagagtaatggtattttctagactgtgaagattcagttcaaatgttatccttgttcctgttacaatatttagcattattagtttgttatgtgtgtatgtttatgttaattttaatttctgattataagacaatgctgctttggttaatctcttctaaatgaattta

SEQ ID NO: 5703 - DNA, 10108 bp, Homo sapiens
gtcacatgagccgcgcgcccgcttcgctccccctcctccccggctgggctgtgtgaatgaagctctgccggctacgtggggcgctcactcaacttggtgtcctggacgccagagccgaccgagcgcgctgcccaccggcggcggacacgggctccgccgctccggacctcggcgacagagcaaatcagttgcctggagttcccagtgaagttgtacctgtgcccgtgcgataacgtcagtggaagctgccccgagtaagtgagggaaatctagaagtttggagcataaaaaaccagcacgaatcaactttacataaacttcatacatttattagcaactgctcgggtttaacttcagggatgttaaatttcgcctagtcccacgggacgatgatcattacttcttaactgcacgcgaaataggagaagaaaaaaggcaaatcaaaacagactgtcccaggtctcagagaagtcatcggagcgctttttcctgctgaattcaccctaggagtttgtttggggctttagccccttggagaaaacagggccacatagctgcctttctatcaagtctccctacaaaactgagaggctctgggaaactcagcctgtgaccccagcgtgggtgaagataggatcaagatggccatgtggcagggtgccatggataacagaggctttcagcaggggagttttagtagcttccagaacagctccagtgatgaagacctgatggacattccagcaaccgctatggatttctccatgagagatgatgttcctcccttagaccgagaagtaggagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattatatttgctttttaaaagatttttttaacttaaaaagtagttagccaatatgcaatcactgaaaactatgcaagagaaattccaaccgtcctgacctataacctgtaggaaaccgacgaaaaagtcactcttttgggatctaactgttgttactggaagacgaagtgtaaactaaggggctttgcttttcaaaccagagaaaggaaagccagaaggaaaagagtaatggtattttctagactgtgaagattcagttcaaatgttatccttgttcctgttacaatatttagcattattagtttgttatgtgtgtatgtttatgttaattttaatttctgattataagacaatgctgctttggttaatctcttctaaatgaatttagagagattgacttttatagcttgcttgttgctggtactcttttgaagtgcacaaagataagttatagagctttctccttgtctgcaaaaacggtaattttccaggtggcatttgttagctggtagacaaggactttgccgtgaatttgttagtagcaaggaatgatttcttccagcttccttgaaatgaataattagtaaacttctaagcaaagtcaatgactaggagtttcacatgtttgtgaggtcctaactaattctcttacccagatgccacctccatgaatgatggtgctttaggcttctggaatatgtaaaaacagcaaagggaaccaagtctagactgcatactggtaaaccagggaagactcagaactgcatatgcatcctcatgcattcctttgtaaagaccaccagtactaaaataactggacactcattgtacctcccagcgataagtatgtgtaacaggccagtgtgttgtccccatgatcatgaattaggcttgggatgcttccaaatatattcaaggtgttggaacaggataggcagctgtgactccctcaagagtccttagaattctaaataaaatgcagagccatcctaagacacaggggtatggacaaggcctggtgacaccaaaggtgcttgtatccaattgaaaaggtgcctgtctcaatttcataccacctttattgcagttaaaaaaaaatcacactctggggacacttggtggaattacagagccaccatcatcattccaaccactatttcattttctgtagttttacctgtgtgcaattactccccctccattctgttccacttcttactccttagtaccaaatcctctgtttgggattgagcgctgctcctggttaatcattcctactacaaaaaaaaataactcccagggctagttaaattgtaaaccaaggctcagcagtctcacaacacatggaccagaggtgacacacagccatttcctttgccatgtggcccagttgctgctgccatgcctccatttccacactggatgcctacggcagtgagatttcactgccggggtaagagttcagcctggatgattttatagctctgttcctagcacttctcatcatccttccagcccagaatcagcggtcattctgcatattcccaccaaccctctacccccaaacacttcagtgtacctcattttaagagttgctgatccctgattctaggacgtttttacccatagttcttgtctttccaaaatctgaaattcttttttttgctcagaactgggtagccaagggttattttatttttatctttaaaataatcaaggcagtcgctagagtttctccttgtgaatagatcactctagcattttaatgaaaaagaaaaaaatctttctggggtatgttgtatcatagtaatggctcagtaaccacatattttgtcctttccatgtcactgattccttcatatgagactatttggcttgactaccctgtatattgtgtagaaatcaaagttcttatctgtacatttctggtccaatacctgtcttattagttgtccttccccactaaagtttgcaaaacagaaaatgttactatttctggtatttaatgacaatgaaaggtttggtcatatttcatagtgcagtagcgataaggagggtgtctcaagtttgcttttgtgtttcttctaggctttgttcttgattttagacagatgagccagtgttaaggtgctacttcagagaataaattagagaaatcagataacactgtgccaaggtatactttgtagatgctaagcaccgattggccctccagagaatgacaatatccctttgatacctcactcctgatcaatctcattcattaacctcagcttctcaggaatccttgtagcttgtatgctagaagtagctatggtatatggtatccactatatgtccagtcctatggtttggctcaaaggttggctaattgcagctagagctctcaactgctagctcagcaccttgacatttgaagtttcttgtcttgaggagaaggaaaatgttctttctgccattgccactttaacagttggacatgcttaagcaacaaatacagccagtatagggaggactgtcagtagcatcaaatggccacatacctcaatggcaaaagactagatggtttgtgatttaaaaattaatgagtcgagatgagactattttggtattaaatgagaaaattgcctaacacaagggaagggtttacaaaagaatgccaattagtgtttcaacagagttaggattttccaagtaagagtagctggtagccatccagccataaaaggaacgagagtctatagatttgtaaaagtaaaactgctatattttgtatcttcaaatcttcaatataaagaatttaaagaacctgaaacagttaatgcatgattcgttatattggagggaaaaagcaggggactgataatacaaaataatggcaactttaaagatcatttctacgtggatgtttggttagaaacatattccaatgctctcctctttctctggccacagcatcctggctcagcccagctgtggagtagaggtggtaagatccacagaacagatatcctctggtagataagctgacattgatgatactttgaatttaccagctggtgaagcaaacgattaatttgtgattgaactgaaaagcagttgaattgttttgacaccagaggctgaatctaaaccctttacaggaagagcagagcatactatacatttcttagcagatcttcaattctgtttgaacatgatgaagtaaccagggtttagtgagatctaaggccgtgaagtaattcacaaccaagatcttatgaacgcattcagatgtgaggggggcaaatatgttttcaaaaacttagtgtgcaatagagtccattatagaaattaaccactgctatatgttttaagtagttcaatcacctgttgtggttcagtcttgattattgtttattttgttaggtgataagtaggaagatgcacttgttatcccacactatctcttgttttgttttgttttgtttttaaataatgaacagtgcaatctttgaacttgagtttttaataatgatagcaaagacaatggtgagaacttgaaacagccagcatattttatattgccaaagtacttactgatgactgaccacactgtcttgtgaggaactgggtcccctgcactggatcagagccaaatgcaagccacccatcagttcagaggaagcaggaaaacatcttttgggtggtgcatagaacattgagctcttaaaaacccggagaaaaattaggaatttagaaagtaagtgggaggtagaatattgagtccttttttaaaaaaaagaattgatgtctaaatatgtagtctgaacttaagtgtcctaaaaccttgttttttgtttttttgttttttgaggagtcgtcttgctctatcaccaggtgggagtgcagtggcacaatctcggctcactgtaacctctgcctcctgcctcccgggtccaagcaattcccctgcctcagtctcccaagtaggtgggactacaggcgcacaccaccatgcccagctaacttttgtatttttagtagagacggggtttcaccatgttggccaggatggtctcgatctcttgacctcgtgatccacccatctcggcctcccaaagtgctgggattataggtgtgagccaccgcacccagccaaaccttgatttttttagccacctctgggattgcctgggttccctttggagaagaaactaaaagttatggccatagaaaaagccctggtaagaaaatatttgaatggtgtaagatggtggaaggaaagccatcccacacccctacaacatatgttctggcatttataaactgcttgattgtgtgcctcaaggggagaaaaagtcaagcaatgcttcaaaggccaggctttctaagcaaatgagtggttcaaagcagtgtttggctcaagggcagtctggttttatggatagggccgacccaagacatctgctcatgaagaaatgtggcatctgttgccatttcctaaactataaggtttagatagattgtcttgaattttgatagcaaatttttttaaatttatatttctgcctcctcgtacatccttatatatggaaaaaaaagtaagagttcctcagatcagagctcagtagctgtgtcaatttgaagttcaatcagtgtagttgtcctggggtgatcgctgactctgctctgtttcatatttcagttgcttgctccaaggagagaatttctgagaacaatgggtgttagcaactttaagttactccccaaacgtttgctggccacattctcatttctaaacatctggatctgggtaaaggtttgaatagatgtagggaacaaaattggtttttccatggtgtagtctaattttgccaaatcacccaagaaagaaagtatatgacgtgtggagtttgcatttcttggatgggacctatcgggtcacccagcccagtcttacagtcataaattcctacctcttagttcctgccaaagggccttcagcctctgtgtgcacacttattgaatgaatgctttgcctaaagtttggccttttgaagaaaaacagcatgtgataatataaaaatatgagagtttaaaaaaaaaaaagatctctgcctctcttctctctgcctcgtcccaccttgctgtctgtctcattgtctttctctcccctcaccatgcgctgaattcagatttctctttcttttattataggcatgttgttttgaatgtggactttgtgggagggagaggattgttctgagaacagaaactggaagatacgtctgagttgatgggaccaacagggctttgctcctctgtgagggccaaagccattgatacttgtcgggggtgatgagggctttagcatctcaaggcagacatatgaagtatttactgctaaactatattacttactagtacaaatctgttggaattcaggggcagtctaagatttggtgagtgaaatgccatctggcaaaatcgagaagagagtgtggcctgagaggggaatgttcagcctcactgtcacattaagggtacctcaaaatacatggtccttccagtgtgttccttttccttcctccatttcactttgtcccctcttcttcctttctctcccattttcctggctttttagcactcagcttttttttataagtatgtatttactttttattatatatttggtcctttgggactttgtgatgattaagaatttattccattcaggattttaaaatgatgtgtttaatattttgttctcttaaactcttttgaagctatgctgctaaccaggtataggccagaaaggaggtggcccagtcagtaccttgctcacgtcagctaagggggacagtgatgtcatgtgggtgactcttcttcatttgaccaaggccagcctcctgttcttacctctgcccattcatttctggctatgggaaaactaccacctgttgagtgagccaatgaggccaggaagatcagaggggctgggttccggcccatgggccactatttgaatttctctgtagtaagctctttgtagggctggctccaactgcagtagccaaagaaaacctgtctgactcgacattttaatgcctgagagttggtgaaagttcagctgaagctaatgtctagacatcagcagtaactaggcatccagaaagtagcttcaaccaaagctaatagagcccaagtttccgcaggaagtttggtgctgagctgtccagagcagttgtttatctgagtgttgctagcccttagccatgctttcttagctttattctcgcctgttcctaggcatagcctgaaccagagctatggctcactgctcgctttattctactccctagtcatgcggaacaacatagtctaaaaaggaagatgtggactggggagttaggagacctgatttctattccctatgcttctactaactagcctcgagatcttaaccgctctgtgcctcagtgttcccatctgcaaaatggggatagtgttaattgccctacctacctcacagggttgttgtgaggataaactgagacaatgaattcaaagcaagttgacaagtaagtgctatgcaaattgtaagaaatggaaacaatcatgttaaaagcaatggaatggacattggcagaagggttaatggattgtccagccctttctctgtgtggcttaaacccaggtcgccattgctttatacattttcacttagcacagatttgtaattatgcatgtaataaagcacagccttatccaccctg

SEQ ID NO: 5704 - DNA, 3046 bp, Homo sapiens
gtgtgaatgaagctctgccggctacgtggggcgctcactcaacttggtgtcctggacgccagagccgaccgagcgcgctgcccaccggcggcggacacgggctccgccgctccggacctcggcgacagagcaaatcagttgcctggagttcccagtgaagttgtacctgtgcccgtgcgataacgtcagtggaagctgccccgagtttggggctttagccccttggagaaaacagggccacatagctgcctttctatcaagtctccctacaaaactgagaggctctgggaaactcagcctgtgaccccagcgtgggtgaagataggatcaagatggccatgtggcagggtgccatggataacagaggctttcagcaggggagttttagtagcttccagaacagctccagtgatgaagacctgatggacattccagcaaccgctatggatttctccatgagagatgatgttcctcccttagaccgagaagtaggagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattat

SEQ ID NO: 5705 - DNA, 2660 bp, Homo sapiens
gggaacactggtagttctttaggtggcgtttgttgctgtgaaaggcagagaatgcagcaagtgcccttctaaagcacttcagactggggcttcttttgtaaaagctccccaacctgaatgaccaaatgcgggctgccaaggttatttcttccttgaggcagaaaaaaagaaaactgtgattgaagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaa

SEQ ID NO: 5706 - DNA, 3353 bp, Homo sapiens
gtcacatgagccgcgcgcccgcttcgctccccctcctccccggctgggctgtgtgaatgaagctctgccggctacgtggggcgctcactcaacttggtgtcctggacgccagagccgaccgagcgcgctgcccaccggcggcggacacgggctccgccgctccggacctcggcgacagagcaaatcagttgcctggagttcccagtgaagttgtacctgtgcccgtgcgataacgtcagtggaagctgccccgagtaagtgagggaaatctagaagtttggagcataaaaaaccagcacgaatcaactttacataaacttcatacatttattagcaactgctcgggtttaacttcagggatgttaaatttcgcctagtcccacgggacgatgatcattacttcttaactgcacgcgaaataggagaagaaaaaaggcaaatcaaaacagactgtcccaggtctcagagaagtcatcggagcgctttttcctgctgaattcaccctaggagtttgtttggggctttagccccttggagaaaacagggccacatagctgcctttctatcaagtctccctacaaaactgagaggctctgggaaactcagcctgtgaccccagcgtgggtgaagataggatcaagatggccatgtggcagggtgccatggataacagaggctttcagcaggggagttttagtagcttccagaacagctccagtgatgaagacctgatggacattccagcaaccgctatggatttctccatgagagatgatgttcctcccttagaccgagaagtaggagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattat

SEQ ID NO: 5707 - DNA, 5477 bp, Homo sapiens
agtcccagagctcgagagggccacgtgaccgtcccggggccagtcacgtgaggcgcagatcctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggagaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtattagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctcctctgtctccttta

SEQ ID NO: 5708 - DNA, 5583 bp, Homo sapiens
ctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggagaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtattagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctcctctgtctccttta

SEQ ID NO: 5709 - DNA, 3014 bp, Homo sapiens
agagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggagaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttc

SEQ ID NO: 5710 - DNA, 963 bp, Homo sapiens
atggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggagaaggaaggccccatgatccacagtggttcggtggtgggagctggcctccctcagtttcagagcatctccttacggaagatccagtttaacttcccctatttccgaagcgacaggtatggaaagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaa

SEQ ID NO: 5711 - DNA, 927 bp, Homo sapiens
atggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggagaaggaaggccccatgatccacagtggttcggtggtgggagctggcctccctcagtttcagagcatctccttacggaagatccagtttaacttcccctatttccgaagcgacaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaa

SEQ ID NO: 5712 - DNA, 1062 bp, Homo sapiens
atggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggagaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagagtcttagagagcctccttgtgtctctggtaaccaccgtggtggtgtttgtggcctcgatggtgttaggagaatgccgacagatgtcctcttcgagtcaaatcggtaa

SEQ ID NO: 5713 - DNA, 2922 bp, Homo sapiens
aagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggagaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagaggtgagcgaggccccggccctgcccccacctttgagagaggatcccctagccaggtgctgtttgtgcacccaggcttctcaccagaaacgtaggcatcccaccaggaggggagagtgtggcccaacactagctttgaaccctgctcggcttccgtgcactcgggaccctttcccctgcctgccagcagatggcaccagcgtcccactggccgtcctttccagccagagccgcgcctctaccaggctgtgtcttcctcctgaaatgttgctcttcactccgtaccactggtgttccttggttctccacctgcgtagggatttgcgcattagatgagagaatttcaagcaaaatactttgagttttacaaagatataaaacacctagtaatta

SEQ ID NO: 5714 - DNA, 814 bp, Homo sapiens
ggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatataaattccagatgaagatgtaaatatgcagaacaaaacttcgggagactatatgttgtcaagagtggggaataatttcttaaaactccagaaggcacagactataagaaaaaacatcaatggggccggacacagtggctcacgcctgtaatcccagcattttgggaggcagaggcaggcggatcacaaggtcaggagattgagaccatcctggctaacacggtgaaaccccgtctctactaaaaatacaaaaaaattagctgggcgtggcggtgtgcgcctgtagtcccagatgctggggaggctgaggcaggagaatggcatgaacctgggaggcggagcttgcagtaagccaagatcacgccactgcactccagcctgggtgacagagcaagactccgtctcaaaaacaaacaaa

SEQ ID NO: 5715 - DNA, 3572 bp, Homo sapiens
tcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgattgaggccgtgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcggcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccccgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcccgcc

SEQ ID NO: 5716 - DNA, 4311 bp, Homo sapiens
attaggcgggaggaccctctggggctgcctggaggaagcctccactccgaccctcgcccgagtgcctactgcgagggcggatgcatgcttcgggacttctaatttcatccttcacgtctttagccgccgcctatggcaaggaaaggcctgccctcgcccctgcctccctcctcccttccccaccgcggctccgtcacgatcggcgcgggcgaccgggcctgggggagcccctccagccggctcctgccctcaggccccgggcgcttccctcgccccgactcccgggcccgaggtcccgggggcggccattcgcctcccaagcactcggcgctcagcccaacggggccgcctttgcagtcgcgtgggcagaacggggtcctcagggccgcggcgattctctagggcgggcggcgccacgacccgccgggagcgcggctcccaggagcccccgcgcgaccgggcctcggtggttgccgttgcaggtcacatggtcgccgtcgctcatcacgtggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccagtcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgattgaggccgtgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcggcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccccgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctc

SEQ ID NO: 5717 - DNA, 2570 bp, Homo sapiens
atcacgtggccccgtcgcgcgtcacgtggccgccggcgcgggtcacgagaacaaacacgggggctgcgcgccagtcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgattgaggccgtgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcggcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgca

SEQ ID NO: 5718 - DNA, 4153 bp, Homo sapiens
gtcgctcatcacgtggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccaggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgattgaggccgtgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcggcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccccgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcccgcctttgccagcgtcgtccctcccaccccacccagaccacgtccaacagcctgggactttcgggaccctggggtcggggcaccgtgtggagtgagaaaggcgtgaaagacagcggctgcggccacccagggcaccagccacatcctcttcctcgtccccgcccctcagcctccctcctctggctcctggctggtgggtctgggggcaaggcagaggcgctccaggtggaggggggcgggccggggtgcccacgctggggtgacgcaagaagaaaactcccgggcctcagagtcggcgccggaaacctaggtctgggtttccctcgtggtggttgtgtactgaggacctggaagtgatcatattttggatatattcggttaaataaaatcagcggttaggattcac

SEQ ID NO: 5719 - DNA, 3310 bp, Homo sapiens
tgctaatgcttttggtacaaatggatgtggaatataattgaatattttcttgtttaaggggagcatgaagaggtgttgaggttatgtcaagcatctggcacagctgaaggcagatggaaatatttacaagtacgcaatttgagactaagatattgttatcattctcctattgaagacaagagcaatagtaaaacacatcaggtcagggggttaaagacctgtgataaaccacttccgataagttggaaacgtgtgtctatattttcatatctgtatatatataatggtaaagaaagacaccttcgtaacccgcattttccaaagagagaaatcacagggagatgtacagcaatggggccatttaagagttctgtgttcatcttgattcttcaccttctagaaggggccctgagtaattcactcattcagctgaacaacaatggctatgaaggcattgtcgttgcaatcgaccccaatgtgccagaagatgaaacactcattcaacaaataaaggacatggtgacccaggcatctctgtatctgcttgaagctacaggaaagcgattttatttcaaaaatgttgccattttgattcctgaaacatggaagacaaaggctgactatgtgagaccaaaacttgagacctacaaaaatgctgatgttctggttgctgagtctactcctccaggtaatgatgaaccctacactgagcagatgggcaactgtggagagaagggtgaaaggatccacctcactcctgatttcattgcaggaaaaaagttagctgaatatggaccacaaggtagggcatttgtccatgagtgggctcatctacgatggggagtatttgacgagtacaataatgatgagaaattctacttatccaatggaagaatacaagcagtaagatgttcagcaggtattactggtacaaatgtagtaaagaagtgtcagggaggcagctgttacaccaaaagatgcacattcaataaagtaacaggactctatgaaaaaggatgtgagtttgttctccaatcccgccagacggagaaggcttctataatgtttgcacaacatgttgattctatagttgaattctgtacagaacaaaaccacaacaaagaagctccaaacaagcaaaatcaaaaatgcaatctccgaagcacatgggaagtgatccgtgattctgaggactttaagaaaaccactcctatgacaacacagccaccaaatcccaccttctcattgctgcagattggacaaagaattgtgtgtttagtccttgacaaatctggaagcatggcgactggtaaccgcctcaatcgactgaatcaagcaggccagcttttcctgctgcagacagttgagctggggtcctgggttgggatggtgacatttgacagtgctgcccatgtacaaaatgaactcatacagataaacagtggcagtgacagggacacactcgccaaaagattacctgcagcagcttcaggagggacgtccatctgcagcgggcttcgatcggcatttactgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaatgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattataaaattttctaaaatgtattttagacttcctgtagggggcgatatactaaatgtatatagtacatttatactaaatgtattcctgtagggggcgatatactaaatgtattttagacttcctgtagggggcgataaaataaaatgctaaacaactgggta

SEQ ID NO: 5720 - DNA, 3118 bp, Homo sapiens
gataaaccacttccgataagttggaaacgtgtgtctatattttcatatctgtatatatataatggtaaagaaagacaccttcgtaacccgcattttccaaagagagaaatcacagggagatgtacagcaatggggccatttaagagttctgtgttcatcttgattcttcaccttctagaaggggccctgagtaattcactcattcagctgaacaacaatggctatgaaggcattgtcgttgcaatcgaccccaatgtgccagaagatgaaacactcattcaacaaataaaggacatggtgacccaggcatctctgtatctgcttgaagctacaggaaagcgattttatttcaaaaatgttgccattttgattcctgaaacatggaagacaaaggctgactatgtgagaccaaaacttgagacctacaaaaatgctgatgttctggttgctgagtctactcctccaggtaatgatgaaccctacactgagcagatgggcaactgtggagagaagggtgaaaggatccacctcactcctgatttcattgcaggaaaaaagttagctgaatatggaccacaaggtagggcatttgtccatgagtgggctcatctacgatggggagtatttgacgagtacaataatgatgagaaattctacttatccaatggaagaatacaagcagtaagatgttcagcaggtattactggtacaaatgtagtaaagaagtgtcagggaggcagctgttacaccaaaagatgcacattcaataaagtaacaggactctatgaaaaaggatgtgagtttgttctccaatcccgccagacggagaaggcttctataatgtttgcacaacatgttgattctatagttgaattctgtacagaacaaaaccacaacaaagaagctccaaacaagcaaaatcaaaaatgcaatctccgaagcacatgggaagtgatccgtgattctgaggactttaagaaaaccactcctatgacaacacagccaccaaatcccaccttctcattgctgcagattggacaaagaattgtgtgtttagtccttgacaaatctggaagcatggcgactggtaaccgcctcaatcgactgaatcaagcaggccagcttttcctgctgcagacagttgagctggggtcctgggttgggatggtgacatttgacagtgctgcccatgtacaaaatgaactcatacagataaacagtggcagtgacagggacacactcgccaaaagattacctgcagcagcttcaggagggacgtccatctgcagcgggcttcgatcggcatttactgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaatgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatccttttttttgattataaaattttctaaaatgtattttagacttcctgtagggggcgatatactaaatgtatatagtacatttatactaaatgtattcctgtagggggcgatatactaaatgtattttagacttcctgtagggggcgataaaataaaatgctaaacaactgggtatacatgcataaaaactatccattcaaaccc

SEQ ID NO: 5721 - DNA, 2608 bp, Homo sapiens
acccgcattttccaaagagagaaatcacagggagatgtacagcaatggggccatttaagagttctgtgttcatcttgattcttcaccttctagaaggggccctgagtaattcactcattcagctgaacaacaatggctatgaaggcattgtcgttgcaatcgaccccaatgtgccagaagatgaaacactcattcaacaaataaaggacatggtgacccaggcatctctgtatctgcttgaagctacaggaaagcgattttatttcaaaaatgttgccattgcaggaaaaaagttagctgaatatggaccacaaggtagggcatttgtccatgagtgggctcatctacgatggggagtatttgacgagtacaataatgatgagaaattctacttatccaatggaagaatacaagcagtaagatgttcagcaggtattactggtacaaatgtagtaaagaagtgtcagggaggcagctgttacaccaaaagatgcacattcaataaagtaacaggactctatgaaaaaggatgtgagtttgttctccaatcccgccagacggagaaggcttctataatgtttgcacaacatgttgattctatagttgaattctgtacagaacaaaaccacaacaaagaagctccaaacaagcaaaatcaaaaatgcaatctccgaagcacatgggaagtgatccgtgattctgaggactttaagaaaaccactcctatgacaacacagccaccaaatcccaccttctcattgctgcagattggacaaagaattgtgtgtttagtccttgacaaatctggaagcatggcgactggtaaccgcctcaatcgactgaatcaagcaggccagcttttcctgctgcagacagttgagctggggtcctgggttgggatggtgacatttgacagtgctgcccatgtacaaaatgaactcatacagataaacagtggcagtgacagggacacactcgccaaaagattacctgcagcagcttcaggagggacgtccatctgcagcgggcttcgatcggcatttactgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaatgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaacctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatcctt

SEQ ID NO: 5722 - DNA, 2475 bp, Homo sapiens
gaggactgacaggggcctgatggaggagttggtggggctgcgtgagggcttctcaggggaccctgtgactctgcaggagctgtggggcccctgtccccacatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgagcacaccagtggctgtacagggagattggggacagccacctgctccggtatctttcctggactgtgtaccctgtggccctcgtctctttctcctcaggcttctcccagagcatcacgccctcctctggaggttctggaatcccggagctgaagaccatgttggcgggtgtgatcttggaggactacctggatatcaagaactttggggccaaggtggtgggcctctcctgcaccctggccaccggcagcaccctgttcctgggcaaagtgggccctttcgtgcacctgtctgtaatgatcgctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactagcaagcctgtgtactccgctctggccaccttgcttctcgcctccatcacctacccgcctggtgtgggccacttcctagcttctcggctgtccatgaagcagcatctggactcgctgttcgacaaccactcctgggcgctgatgacccagaactccagcccaccctggcccgaggagctcgacccccagcacctttggtgggaatggtaccacccgcggttcaccatctttgggacccttgccttcttcctggttatgaagttctggatgctgattctggccaccaccatccccatgcctgccgggtacttcatgcccatctttatccttggagctgccatcgggcgcctcttgggagaggctcttgccgtcgccttccctgagggcattgtgactggaggggttaccaatcccatcatgcccggggggtatgctctggcaggggctgcagccttctcaggggctgtgacccacaccatctccacggcgctgctggcctttgagctgaccggccagatagtgcatgcactgcccgtgctgatggcggtgctggcagccaacgccattgcacagagctgccagccctccttctatgatggcaccatcattgtcaagaagctgccatacctgccacggattctgggccgcaacatcggctcccaccatgtgagggtggagcacttcatgaaccacagcatcaccacactggccaaggacacgccgctggaggaggtggtcaaggttgtgacctccacagacgtgaccgagtatcccctggtggagagcacagagtcccagatcctggtaggcatcgtgcagagggcccagctggtgcaggccctccaggctgagcctccttccagggctccaggacaccagcagtgtctccaggacatcttggccaggggctgccccacggaaccagtgaccctgacgctattctcagagaccaccttgcaccaggcacaaaacctctttaagctgttgaaccttcagtccctcttcgtgacatcgcggggcagagctgtgggctgcgtgtcctgggtggagatgaagaaagcaatttccaacctgacaaatccgccagctccaaagtgagccggcccagcaagatgaaacagggcaccccagctgacctggtactgaggttgggctgagaccctgcttctcttcccccatcaccacctgcccctccctccagcccagctccattctttggcataacaggcaactctaacctagcccagaagaggatggctcatcctgggtgggacgatggctcctgccttgaaagacaaaaatcccaccttgggcagagctgagtgtgagaagatggaaaaccagtatctgccaggtgctcagtgactggccatcacattaatgaatgacgagattggagtacactgtcaccaagggcaggcaaagatgccctctggggttgtctggttcccagtgagaggctcctgagaaaaataaagctggttcccaga

SEQ ID NO: 5723 - DNA, 2581 bp, Homo sapiens
gcctccacagttctggttggtttgtcaaggacgtttttaatctccatggtgcactggagctgggagcaaaggaggctctgtgagaggagggccagttcagccgcagcaggaggactgacaggggcctgatggaggagttggtggggctgcgtgagggcttctcaggggaccctgtgactctgcaggagctgtggggcccctgtccccacatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgagcacaccagtggctgtacagggagattggggacagccacctgctccggtatctttcctggactgtgtaccctgtggccctcgtctctttctcctcaggcttctcccagagcatcacgccctcctctggaggttctggaatcccggagctgaagaccatgttggcgggtgtgatcttggaggactacctggatatcaagaactttggggccaaggtggtgggcctctcctgcaccctggccaccggcagcaccctgttcctgggcaaagtgggccctttcgtgcacctgtctgtaatgatcgctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactagcaagcctgtgtactccgctctggccaccttgcttctcgcctccatcacctacccgcctggtgtgggccacttcctagcttctcggctgtccatgaagcagcatctggactcgctgttcgacaaccactcctgggcgctgatgacccagaactccagcccaccctggcccgaggagctcgacccccagcacctttggtgggaatggtaccacccgcggttcaccatctttgggacccttgccttcttcctggttatgaagttctggatgctgattctggccaccaccatccccatgcctgccgggtacttcatgcccatctttatccttggagctgccatcgggcgcctcttgggagaggctcttgccgtcgccttccctgagggcattgtgactggaggggttaccaatcccatcatgcccggggggtatgctctggcaggggctgcagccttctcaggggctgtgacccacaccatctccacggcgctgctggcctttgagctgaccggccagatagtgcatgcactgcccgtgctgatggcggtgctggcagccaacgccattgcacagagctgccagccctccttctatgatggcaccatcattgtcaagaagctgccatacctgccacggattctgggccgcaacatcggctcccaccatgtgagggtggagcacttcatgaaccacagcatcaccacactggccaaggacacgccgctggaggaggtggtcaaggttgtgacctccacagacgtgaccgagtatcccctggtggagagcacagagtcccagatcctggtaggcatcgtgcagagggcccagctggtgcaggccctccaggctgagcctccttccagggctccaggacaccagtgtctccaggacatcttggccaggggctgccccacggaaccagtgaccctgacgctattctcagagaccaccttgcaccaggcacaaaacctctttaagctgttgaaccttcagtccctcttcgtgacatcgcggggcagagctgtgggctgcgtgtcctgggtggagatgaagaaagcaatttccaacctgacaaatccgccagctccaaagtgagccggcccagcaagatgaaacagggcaccccagctgacctggtactgaggttgggctgagaccctgcttctcttcccccatcaccacctgcccctccctccagcccagctccattctttggcataacaggcaactctaacctagcccagaagaggatggctcatcctgggtgggacgatggctcctgccttgaaagacaaaaatcccaccttgggcagagctgagtgtgagaagatggaaaaccagtatctgccaggtgctcagtgactggccatcacattaatgaatgacgagattggagtacactgtcaccaagggcaggcaaagatgccctctggggttgtctggttcccagtgagaggctcctgagaaaaataaagctggttcccaga

SEQ ID NO: 5724 - DNA, 2530 bp, Homo sapiens
gtgcactggagctgggagcaaaggaggctctgtgagaggagggccagttcagccgcagcaggaggactgacaggggcctgatggaggagttggtggggctgcgtgagggcttctcaggggaccctgtgactctgcaggagctgtggggcccctgtccccacatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgagcacaccagtggctgtacagggagattggggacagccacctgctccggtatctttcctggactgtgtaccctgtggccctcgtctctttctcctcaggcttctcccagagcatcacgccctcctctggaggttctggaatcccggagctgaagaccatgttggcgggtgtgatcttggaggactacctggatatcaagaactttggggccaaggtggtgggcctctcctgcaccctggccaccggcagcaccctgttcctgggcaaagtgggccctttcgtgcacctgtctgtaatgatcgctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactagcaagcctgtgtactccgctctggccaccttgcttctcgcctccatcacctacccgcctggtgtgggccacttcctagcttctcggctgtccatgaagcagcatctggactcgctgttcgacaaccactcctgggcgctgatgacccagaactccagcccaccctggcccgaggagctcgacccccagcacctttggtgggaatggtaccacccgcggttcaccatctttgggacccttgccttcttcctggttatgaagttctggatgctgattctggccaccaccatccccatgcctgccgggtacttcatgcccatctttatccttggagctgccatcgggcgcctcttgggagaggctcttgccgtcgccttccctgagggcattgtgactggaggggttaccaatcccatcatgcccggggggtatgctctggcaggggctgcagccttctcaggggctgtgacccacaccatctccacggcgctgctggcctttgagctgaccggccagatagtgcatgcactgcccgtgctgatggcggtgctggcagccaacgccattgcacagagctgccagccctccttctatgatggcaccatcattgtcaagaagctgccatacctgccacggattctgggccgcaacatcggctcccaccatgtgagggtggagcacttcatgaaccacagcatcaccacactggccaaggacacgccgctggaggaggtggtcaaggttgtgacctccacagacgtgaccgagtatcccctggtggagagcacagagtcccagatcctggtaggcatcgtgcagagggcccagctggtgcaggccctccaggctgagcctccttccagggctccaggacaccagtgtctccaggacatcttggccaggggctgccccacggaaccagtgaccctgacgctattctcagagaccaccttgcaccaggcacaaaacctctttaagctgttgaaccttcagtccctcttcgtgacatcgcggggcagagctgtgggctgcgtgtcctgggtggagatgaagaaagcaatttccaacctgacaaatccgccagctccaaagtgagccggcccagcaagatgaaacagggcaccccagctgacctggtactgaggttgggctgagaccctgcttctcttcccccatcaccacctgcccctccctccagcccagctccattctttggcataacaggcaactctaacctagcccagaagaggatggctcatcctgggtgggacgatggctcctgccttgaaagacaaaaatcccaccttgggcagagctgagtgtgagaagatggaaaaccagtatctgccaggtgctcagtgactggccatcacattaatgaatgacgagattggagtacactgtcaccaagggcaggcaaagatgccctctggggttgtctggttcccagtgagaggctcctgagaaaaataaagctggttccc

SEQ ID NO: 5725 - DNA, 1997 bp, Homo sapiens
gaggctctgtgagaggagggccagttcagccgcagcaggaggactgacaggggcctgatggaggagttggtggggctgcgtgagggcttctcaggggaccctgtgactctgcaggagctgtggggcccctgtccccacatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgaggttctggaatcccggagctgaagaccatgttggcgggtgtgatcttggaggactacctggatatcaagaactttggggccaaggtggtgggcctctcctgcaccctggccaccggcagcaccctgttcctgggcaaagtgggccctttcgtgcacctgtctgtaatgatcgctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactagcaagcctgtgtactccgctctggccaccttgcttctcgcctccatcacctacccgcctggtgtgggccacttcctagcttctcggctgtccatgaagcagcatctggactcgctgttcgacaaccactcctgggcgctgatgacccagaactccagcccaccctggcccgaggagctcgacccccagcacctttggtgggaatggtaccacccgcggttcaccatctttgggacccttgccttcttcctggttatgaagttctggatgctgattctggccaccaccatccccatgcctgccgggtacttcatgcccatctttatccttggagctgccatcgggcgcctcttgggagaggctcttgccgtcgccttccctgagggcattgtgactggaggggttaccaatcccatcatgcccggggggtatgctctggcaggggctgcagccttctcaggggctgtgacccacaccatctccacggcgctgctggcctttgagctgaccggccagatagtgcatgcactgcccgtgctgatggcggtgctggcagccaacgccattgcacagagctgccagccctccttctatgatggcaccatcattgtcaagaagctgccatacctgccacggattctgggccgcaacatcggctcccaccatgtgagggtggagcacttcatgaaccacagcatcaccacactggccaaggacacgccgctggaggaggtggtcaaggttgtgacctccacagacgtgaccgagtatcccctggtggagagcacagagtcccagatcctggtaggcatcgtgcagagggcccagctggtgcaggccctccaggctgagcctccttccagggctccaggacaccagcagtgtctccaggacatcttggccaggggctgccccacggaaccagtgaccctgacgctattctcagagaccaccttgcaccaggcacaaaacctctttaagctgttgaaccttcagtccctcttcgtgacatcgcggggcagagctgtgggctgcgtgtcctgggtggagatgaagaaagcaatttccaacctgacaaatccgccagctccaaagtgagccgg

SEQ ID NO: 5726 - DNA, 1520 bp, Homo sapiens
ggggggaggatgttgattgttggaacacacacctgtccaggtgcaggggagctggaggctctgtgagaggagggccagctcagccacagcaggaggactgacaggggcctgatggaggagtttgtggggctgcgtgaaggctcctcagggaaccctgtgactctgcaggagctgtggggcccctgtccccgcatccgccgaggcatccgaggtggcctggagtggctgaagcagaagctcttccgcctgggcgaggactggtacttcctgatgaccctcggggtgctcatggccctggtcagctgtgccatggacttggctgttgagagtgtggtccgagcgcaccagtggctgtacagggagattggggacagccacctgctccggtatctctcctggactgtgtaccctgtggccctcgtctctttctcttcaggcttctctcagagcatcacaccctcctctggaggttctggaatcccggaggtgaagaccatgttggcgggtgtggtcttggaggactacctggatatcaagaactttggggccaaagtggtgggcctctcctgcaccctggcctgtggcagcaccctcttcctcgggaaagtgggccctttcgtgcacctgtctgtgatgatggctgcctacctgggccgtgtgcgcaccacgaccatcggggagcctgagaacaagagcaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccatcacattaatgaatgatgagattggagtacactgtcaccaagggcaggcacagatgccttctggggttgtctggttcccagtgagaggctcctgagaaaaataaagctggttccc

SEQ ID NO: 5727 - DNA, 2129 bp, Homo sapiens
aacattatacagacttgggtttgaaatccacgtatgaccctggcccgttggcctctctgagcccggcttcctcctctacaaaatggagatcgcaaccgtccccacccgatagcgagagggcgcacacccgcattccaggctggacgggtctctgggcagcgggctcctccccgcccagggcgcatgccctgccctcccctcctgtctgtccctgtccgggctgcaggagagcaggacagatgggtcagggaggaggtgacatggggagggggtcctacagtcacaggtgggtgggggtggagggcccacctgagatcagtgtcgcccccaggcgtcctgttcagcatcgaggtcatgtcttcccacttctctgtctgggattactggaggggcttctttgcggccacctgcggggccttcatgttccggctcctggcggtcttcaacagcgagcaggagaccatcacctccctctacaagaccagtttccgggtggacgttcccttcgacctgcctgagatcttcttttttgtggcgctggggggtctctgtggcatcctgggcagcgcttacctcttctgtcagcgaatcttctttggcttcatcaggaacaataggttcagctccaaactgctggccaccagcaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacatgccactggaggaggtggtcaaggttgtgacctccacagacgtggccaagtatcccctggtggagagcacagagtcccagatcctggtgggcatagtgcgaagggcccagctggtgcaggccctgaaggctgagcctccttcctgggctcctggacaccagtgtctccaggacatcttggctgcaggctgccccacagaaccagtgaccctgaagctgtccccagagacttccctgcatgaggcacacaacctctttgagctgttgaaccttcattccctctttgtgacgtcgcggggcagagctgtgggctgcgtgtcctgggtggagatgaagaaagcaatttccaacctgacaaatccgccagccccaaagtgagccggcccagcaagatgaaacagggcaccccagctgacctggtactgaggttgggctgagaccctgcttctcttcccccatcaccacctgcccctccctccagcccagctccattctttggcataacaggcaactttaacctagcccagaagaggatggctcatcctgggtgggacgatggctcctgccttgaaagacaaaaatcccaccttgggcagagctgagtgtgagaagatggaaaaccagtatctgccagttgctcagtgactggccatcacattaatgaatgatgagattggagtacactgtcaccaagggcaggcacagatgccttctggggttgtctggttcccagtgagaggctcctgagaaaaataaagctggttcccaga

SEQ ID NO: 5728 - DNA, 2110 bp, Homo sapiens
ataaaccctgggcccaggcgggaaaggggggaggatgttgattgttggaacacacacctgtccaggtgcaggggagctggaggctctgtgagaggagggccagctcagccacagcaggaggactgacaggggcctgatggaggagtttgtggggctgcgtgaaggctcctcagggaaccctgtgactctgcaggagctgtggggcccctgtccccgcatccgccgaggcatccgaggtggcctggagtggctgaagcagaagctcttccgcctgggcgaggactggtacttcctgatgaccctcggggtgctcatggccctggtcagctgtgccatggacttggctgttgagagtgtggtccgagcgcaccagtggctgtacagggagattggggacagccacctgctccggtatctctcctggactgtgtaccctgtggccctcgtctctttctcttcaggcttctctcagagcatcacaccctcctctggaggttctggaatcccggaggtgaagaccatgttggcgggtgtggtcttggaggactacctggatatcaagaactttggggccaaagtggtgggcctctcctgcaccctggcctgtggcagcaccctcttcctcgggaaagtgggccctttcgtgcacctgtctgtgatgatggctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtctgggattactggaggggcttctttgcggccacctgcggggccttcatgttccggctcctggcggtcttcaacagcgagcaggagaccatcacctccctctacaagaccagtttccgggtggacgttcccttcgacctgcctgagatcttcttttttgtggcgctggggggtctctgtggcatcctgggcagcgcttacctcttctgtcagcgaatcttctttggcttcatcaggaacaataggttcagctccaaactgctggccaccagcaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacatgccactggaggaggtggtcaaggttgtgacctccacagacgtggccaagtatcccctggtggagagcacagagtcccagatcctggtgggcatagtgcgaagggcccagctggtgcaggccctgaaggctgagcctccttcctgggctcctggacaccagtgtctccaggacatcttggctgcaggctgccccacagaaccagtgaccctgaagctgtccccagagacttccctgcatgaggcacagatgccttctggggttgtctggttcccagtgagaggctcctga

SEQ ID NO: 5729 - DNA, 2567 bp, Homo sapiens
ggggggaggatgttgattgttggaacacacacctgtccaggtgcaggggagctggaggctctgtgagaggagggccagctcagccacagcaggaggactgacaggggcctgatggaggagtttgtggggctgcgtgaaggctcctcagggaaccctgtgactctgcaggagctgtggggcccctgtccccgcatccgccgaggcatccgaggtggcctggagtggctgaagcagaagctcttccgcctgggcgaggactggtacttcctgatgaccctcggggtgctcatggccctggtcagctgtgccatggacttggctgttgagagtgtggtccgagcgcaccagtggctgtacagggagattggggacagccacctgctccggtatctctcctggactgtgtaccctgtggccctcgtctctttctcttcaggcttctctcagagcatcacaccctcctctggaggttctggaatcccggaggtgaagaccatgttggcgggtgtggtcttggaggactacctggatatcaagaactttggggccaaagtggtgggcctctcctgcaccctggcctgtggcagcaccctcttcctcgggaaagtgggccctttcgtgcacctgtctgtgatgatggctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtctgggattactggaggggcttctttgcggccacctgcggggccttcatgttccggctcctggcggtcttcaacagcgagcaggagaccatcacctccctctacaagaccagtttccgggtggacgttcccttcgacctgcctgagatcttcttttttgtggcgctggggggtctctgtggcatcctgggcagcgcttacctcttctgtcagcgaatcttctttggcttcatcaggaacaataggttcagctccaaactgctggccaccagcaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacatgccactggaggaggtggtcaaggttgtgacctccacagacgtggccaagtatcccctggtggagagcacagagtcccagatcctggtgggcatagtgcgaagggcccagctggtgcaggccctgaaggctgagcctccttcctgggctcctggacaccagcagtgtctccaggacatcttggctgcaggctgccccacagaaccagtgaccctgaagctgtccccagagacttccctgcatgaggcacacaacctctttgagctgttgaaccttcattccctctttgtgacgtcgcggggcagagctgtgggctgcgtgtcctgggtggagatgaagaaagcaatttccaacctgacaaatccgccagccccaaagtgagccggcccagcaagatgaaacagggcaccccagctgacctggtactgaggttgggctgagaccctgcttctcttcccccatcaccacctgcccctccctccagcccagctccattctttggcataacaggcaactttaacctagcccagaagaggatggctcatcctgggtgggacgatggctcctgccttgaaagacaaaaatcccaccttgggcagagctgagtgtgagaagatggaaaaccagtatctgccagttgctcagtgactggccatcacattaatgaatgatgagattggagtacactgtcaccaagggcaggcacagatgccttctggggttgtctggttcccagtgagaggctcctgagaaaaataaagctggttcccaga

SEQ ID NO: 5730 - DNA, 464 bp, Homo sapiens
gcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacatgccactggaggaggtggtcaaggttgtgacctccacagacgtggccaagtatcccctggtggagagcacagagtcccagatcctggtgggcatagtgcgaagggcccagctggtgcaggccctgaaggctgagcctccttcctgggctcctggacaccagtgtctccaggacatcttggctgcaggctgccccacagaaccagtgaccctgaagctgtccccagagacttccctgcatgaggcacagatgccttctggggttgtctggttcccagtgagaggctcctgagaaaaataaagctggttcccaga

SEQ ID NO: 5731 - DNA, 3187 bp, Homo sapiens
ctctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagttctggatgtctgcactggccaccaccatcccagttccctgtggggccttcatgcctgtctttgtcattgatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctacccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccacttatatata

SEQ ID NO: 5732 - DNA, 2897 bp, Homo sapiens
actctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagttctggatgtctgcactggccaccaccatcccagttccctgtggggccttcatgcctgtctttgtcattggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctacccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagactcacactatcttctcactgctgggagtggaccatgcttatgtcaccagtattggcagactcattggaatcgttactctaaaggagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggca

SEQ ID NO: 5733 - DNA, 2820 bp, Homo sapiens
actctgctctcggcctcccgggctgcggggacgggacggctgccggcgcggactttgcgggccgggagccgagtccaggacagagccggaaccgccgagggaggcgagagggcagtgcgcggagatggcggccgcggcggcggaggaagggatggagccacgggcgctgcagtacgagcagaccctgatgtatggccggtacactcaggaccttggggcctttgccaaagaggaagctgctcggattcgcctgggagggcctgaaccctggaaaggtcccccttcctctcgggctgccccagagctcttggaatatggacggagccgttgcgcccgatgccgcgtctgttctgtccgctgccacaagttcctagtatccagggttggtgaagattggatcttcctggtcctgctggggcttctcatggcattggtcagctgggtcatggactatgccattgctgcctgtctgcaagcccagcagtggatgtcccggggcttgaacaccagcatcttgctccagtacctggcctgggtcacctaccctgttgtcctcatcactttctcagccggattcacacagatcctggcccctcaggctgtcggctctggcatccctgagatgaagaccatcttgcggggagtggtgctgaaagaatacctcacactcaagacctttatagctaaggtcattgggctgacctgcgccctaggcagcgggatgccgcttggcaaagagggcccttttgtgcatatcgcaagcatgtgtgctgcccttctcagcaagttcctctccctctttgggggtatctatgagaatgaatcccggaacacagagatgctggctgccgcctgtgccgtgggggtgggctgctgcttcgcggcacctattggaggcgtcctcttcagcatcgaggtcacctccaccttctttgcagtgcggaactactggcggggcttcttcgctgccaccttcagtgccttcatcttccgggtcttggcagtctggaaccgggatgaagagactattacagccctcttcaaaacccgattccggctcgacttcccctttgacctgcaggagctgccagcctttgctgtcattggtattgctagtggcttcggtggagccctctttgtctacctgaaccggaagattgtccaggtgatgcggaagcagaaaaccatcaatcgcttcctcatgaggaaacgcctgctcttcccggctctggtgaccctgctcatctccacgctgaccttcccccctggctttggacagttcatggctggacagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaagttctggatgtctgcactggccaccaccatcccagttccctgtggggccttcatgcctgtctttgtcattggagcagcatttgggcgtctggtgggtgaaagcatggctgcctggttcccagatggaattcatacggacagcagcacctaccggattgtgcctgggggctacgctgtggtcggggcagctgcgctggcaggagcggtgacacacacagtgtccacggctgtgatcgtgttcgagctcacaggccagattgcccacatcctgcctgtcatgatcgccgtcatcctggccaacgctgtcgcccagagtctgcagccctccctctatgacagcatcatccgaatcaagaaactgccctacctgcctgagctcggctggggccgccaccagcagtaccgggtgcgtgtggaggacatcatggtgcgggatgttccccatgtggccctcagctgcaccttccgggacctgcgtttggcactgcacaggaccaagggccgaatgctggccctagtggagtcccctgagtccatgattctgctgggctccatcgagcgttcacaggtggtggcattgttgggggcccagctgagcccagcccgccggcggcagcacatgcaggagcgcagagccacccagacctctccactatctgatcaggagggtccccctacccctgaggcttctgtctgcttccaggtgaacacagaagactcagccttcccagcagcccggggggagacccacaagcccctaaagcctgcactcaagagggggcccagtgtcaccaggaacctcggagagagtcccacagggagcgcagagtcggcaggcatcgccctccggagcctcttctgtggcagtccaccccctgaggctgcttcggagaagttggaatcctgtgagaagcgcaagctgaagcgtgtccgaatctccctggcaagtgacgcggacctggaaggcgagatgagccctgaagagattctggagtgggaggagcagcaactagatgaacctgtcaacttcagtgactgcaaaattgatcctgctcccttccagctggtggagcggacctctttgcacaagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggca

SEQ ID NO: 5734 - DNA, 2993 bp, Homo sapiens
ggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctatattactttgctctcattcttgactaaaaccattaatgagaaatgttttttaaaaaataatgctggcaaatatgagaattttgttggctttatttttgtttacttgttgagaagatgaacatgaaattaataagaaaatatagttatagcttctggcaagtatttagtaaggcaaagatttaacacatttcaggggatttctgccacttccttttagatcagcagtaatttcttatatttatcaactctcaatttttagttttcatagatacctgggtattataaggctgatttgtaattactgatttatacttggacttttgaaatcattatgtgtccttaaaaataaggttatacaagctaaccttcttaacaggatcacatggctaattagtgactaaactgatgtttggtaccactcagcccagtgttcatttcagcactgtcacttggtttcccttatcttgcaaggtagactgaaaaaaaacgaattttcctttttctaaccagactctcagaatttctgagtctgttaacaataggcaagtaaaacagccacttgaaatggaaactaaaatttactgagacctctgtactagccactgtcctgagttctttattatgtattataatattcttaattatcttatgagatacgcttttatcccactttatagttgaggaaactgagttatagagagaggtaaaataacttgcttaaggtcatgtagatagtgaattgtgatttttgagcctgtgctttaaaacatcatacagccttaccacctaccagcagcagaaagcatgcacactctccccactgctgcagggtttcagtgttaacatttcaatggccagtacaagagcttccccagtttctctgctacccatctgagcaacacccataattctatcctagaagtttgtccattcttcagtaatcagtcaggacattctcacaggctaatattagaaattccatttgagttccttttaaaaggaacaaatttataattgtgactttccatgaacataaattgctctgatagcaaaatgtcgagaagattcagagtgtacttggtttcttgttggtgttgctgtggtcaatgcaatatgcaaaaaggcaggagaccaaagcatgtgggcacctctctgggcttatttcctcattagactaagtgactttcaaagattgagctgtaacattcactagatagttagaaccgtagcattgagaaaatagaagctgagaaaaaagagcaggtcaggcttttaaaagataaaatttataatgatcagccagacaatatttattgatttcatttgagcctaattttagggttgctggaattgttttctttgtgtgttcctgatgtagagacactttaaaggtacatagacatttcccctccaaaatgtaagtcatctaaatgttcctaaaagctagggttaatggttctctgttctaggttcttcatttaaaaaatgtattcattaagatatggtcccagccggacgtggtggctcacacctgtaatcccagcactttgggaggctcaggtgggcagatcacttgaggtcaggagtttgagaccagcctggccaatacggtgaaaacccatctct

SEQ ID NO: 5735 - DNA, 953 bp, Homo sapiens
tgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagaaaccagccttttaaagttccagttagcttccaagttactgctattgtgaaaactgtataacattgcttcttatactgaccatgaattgtgatactggacctgtgctttcttctcacatcctgccagtggaactatcagaaaataacctcttaga

SEQ ID NO: 5736 - DNA, 760 bp, Homo sapiens
gcgcctgaccgcggcagctcccaccatggcggagaccaagctccagctgtttgtcaaggtgcagggcggactcagctgcggggagggtgtctgggaggaagcgcttttctgggctttgctttctgtggcaggctgtggggtgggcctcccagtaatgtctgagccccttcctgtgggtggctagggggactcaggcagccctacagaggctgagtaaagtgggacccagcgatcactgcccctcctgccagcggctcttcatggtcctgctcctcaagggcgtacctttcaccctcaccacggtggacacgcgcaggtccccggacgtgctgaaggacttcgcccccggctcgcagctgcccatcctgctctatgacagcgacgccaagacagacacgctgcagatcgaggactttctggaggagacgctggggccgcccgacttccccagcctggcgcctcgttacagggagtccaacaccgccggcaacgacgttttccacaagttctccgcgttcatcaagaacccggtgcccgcgcaggacgaagccctgtaccagcagctgctgcgcgccctcgccaggctggacagctacctgcgcgcgcccctggagcacgagctggcgggggagccgcagctgcgcgagtcccgccgccgcttcctggacggcgacaggctcacgctggccgactgcagcctcctgcccaagctgcacatcgtcgacacggtgtgcgcgcacttccgccaggcgcccatccc

SEQ ID NO: 5737 - DNA, 1017 bp, Homo sapiens
ggatctccgtgcacaccagactcaagtccagggcagccccccacaccattccgccaccctgaggtcacaccctcaggctcagacaccccggggccgggctggcgttgctcaggcagctggttctgcgcgctgggcagcttcatctgcccgcctaggtggctccacggggcgggcccctcggccagggagggcggggcgcacagggagacttaaagagctccccaggtccccacccgcgcctgaccgcggcagctcccaccatggcggagaccaagctccagctgtttgtcaaggcgagtgaggacggggagagcgtgggtcactgcccctcctgccagcggctcttcatggtcctgctcctcaagggcgtacctttcaccctcaccacggtggacacgcgcaggtccccggacgtgctgaaggacttcgcccccggctcgcagctgcccatcctgctctatgacagcgacgccaagacagacacgctgcagatcgaggactttctggaggagacgctggggccgcccgacttccccagcctggcgcctcgttacagggagtccaacaccgccggcaacgacgttttccacaagttctccgcgttcatcaagaacccggtgcccgcgcaggacgaagccctgtaccagcagctgctgcgcgccctcgccaggctggacagctacctgcgcgcgcccctggagcacgagctggcgggggagccgcagctgcgcgagtcccgccgccgcttcctggacggcgacaggctcacgctggccgactgcagcctcctgcccaagctgcacatcgtcgacacggtgtgcgcgcacttccgccaggcgcccatccccgcggagctgcgcggcgtacgccgctacctggacagcgcgatgcaggagaaagagttcaaatacacgtgtccgcacagcgccgagatcctggcggcctaccggcccgccgtgcacccccgctagcgccccaccccgcgtctgtcgcccaataaaggcatctttgtcggga

SEQ ID NO: 5738 - DNA, 830 bp, Homo sapiens
cacttcaaccggttgtcgccccagtggccgccctctgagcacgtgttactgccagtctgcgtcagcgttgggtaaatacatgactggccgacgccgccgggtggggctatttaagagacagccgcccgctggtcctccctgaacttggctcagctgccgggctgctccggttggaaacgccaagccagctgcgtcctaatccaaaagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctgc

SEQ ID NO: 5739 - DNA, 1527 bp, Homo sapiens
ctggcgttgccacagtccctccattccagagggaattccagagcggaatacggattccgattttaaaataagcgcttctaaatctttctccttgcatctaagacgggtgggggaaagaaagggagaggagttgaggtcccaaggttcaaggcctggtgatctccaggtcccaggctgggcggcctcggtgcacggagagggcgaggggcgtgttgtggagccttggcaaggcgctgctcttcctcgcgcctcggtttgcggtctgtgaaatggggttggcagtgcctttgcagggacgcggcgaactcaagcaccagcaagcggactcgaactcaaagggtttcagggtgtagacgaccagagcgcactgaggggctccaggtcggcccgctccggagccgggagagtaaccgcgtgcagggaaaggcgcacggcagcctcggtgcctcccttccctccaccggacgggtgactgactaggggtgaggtcctcacctccaggctgcgcagctgagttctggaagctgcgtcaagagaggcccaggacaccaagagccagctgtggccagagccctttcactgacccagaacactggccctcggaaacctggagaactgcgagggcttttaatgcggctgagaagaaagtgaagaccccgactcctcctctctccttcgaaagagccgacacaggagccacttcaaccggttgtcgccccagtggccgccctctgagcacgtgttactgccagtctgcgtcagcgttgggtaaatacatgactggccgacgccgccgggtggggctatttaagagacagccgcccgctggtcctccctgaacttggctcagctgccgggctgctccggttggaaacgccaagccagctgcgtcctaatccaaaagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctgc

SEQ ID NO: 5740 - DNA, 747 bp, Homo sapiens
gagaggcactctgcaaacacttcctcaaactttaggaaagcaaaaacattccttctgctcaacacggcagaaaacagggtctctgccccttggcgctgggtgaggagttcccaaagaccagccagccatgaacagcggcgtgtgcctgtgcgtgctgatggcggtactggcggctggcgccctgacgcagccggtgcctcccgcagatcccgcgggctccgggctgcagcgggcagaggaggcgccccgtaggcagctgagggtatcgcagagaacggatggcgagtcccgagcgcacctgggcgccctgctggcaagatacatccagcaggcccggaaagctccttctggacgaatgtccatcgttaagaacctgcagaacctggaccccagccacaggataagtgaccgggactacatgggctggatggattttggccgtcgcagtgccgaggagtatgagtacccctcctagaggacccagccgccatcagcccaacgggaagcaacctcccaacccagaggaggcagaataagaaaacaatcacactcataactcattgtctgtggagtttgacattgtatgtatctatttattaagttctcaatgtgaaaaatgtgtctgtaagattgtccagtgcaaccacacacctcaccagaattgtgcaaatggaagacaaaatgttttcttcatctgtgactcctggtctgaaaatgttgttatgctattaaagtgatttcattctg

SEQ ID NO: 5741 - DNA, 1720 bp, Homo sapiens
tacaaatgctggagtgagtgaggtgaactcaagtcgcctttaggaatggctgaaaaagcccacacctggaaatcactccctccctgctcctccacggcaggttgcatctgcgagacgcttcggtcattagaggaatgagccgggagtgagcaattcaccagctctccagcacttggtggaaagcagcaggcaaggatggatgtggttgacagccttcttgtgaatggaagcaacatcactcctccctgtgaactcgggctcgaaaatgagacgcttttctgcttggatcagccccgtccttccaaagagtggcagccagcggtgcagattctcttgtactccttgatattcctgctcagcgtgctgggaaacacgctggtcatcaccgtgctgattcggaacaagcggatgcggacggtcaccaacatcttcctcctctccctggctgtcagcgacctcatgctctgtctcttctgcatgccgttcaacctcatccccaatctgctcaaggatttcatcttcgggagcgccgtttgcaagaccaccacctacttcatgggcacctctgtgagtgtatctacctttaatctggtagccatatctctagagagatatggtgcgatttgcaaacccttacagtcccgggtctggcagacaaaatcccatgctttgaaggtgattgctgctacctggtgcctttcctttaccatcatgactccgtaccccatttatagcaacttggtgccttttaccaaaaataacaaccagaccgcgaatatgtgccgctttctactgccaaatgatgttatgcagcagtcctggcacacattcctgttactcatcctctttcttattcctggaattgtgatgatggtggcatatggattaatctctttggaactctaccagggaataaaatttgaggctagccagaagaagtctgctaaagaaaggaaacctagcaccaccagcagcggcaaatatgaggacagcgatgggtgttacctgcaaaagaccaggcccccgaggaagctggagctccggcagctgtccaccggcagcagcagcagggccaaccgcatccggagtaacagctccgcagccaacctgatggccaagaaaagggtgatccgcatgctcatcgtcatcgtggtcctcttcttcctgtgctggatgcccatcttcagcgccaacgcctggcgggcctacgacaccgcctccgcagagcgccgcctctcaggaacccccatttccttcatcctcctcctgtcctacacctcctcctgcgtcaaccccatcatctactgcttcatgaacaaacgcttccgcctcggcttcatggccaccttcccctgctgccccaatcctggtcccccaggggcgaggggagaggtgggggaggaggaggaaggcgggaccacaggagcctctctgtccaggttctcgtacagccatatgagtgcctcggtgccaccccagtgagatgtcccctgaccctccaccgcagaaggaaggcagggaggaggcagagaagaaagaacggaagaagagatcaggaagagaaggagcagagctgatggagaaggaaggctccatctccagtgggaactcttcaaggtctgcttttcatccttcatctggattccagagcactgctccagtggggccatgattggtttctaggcagttcaaagcaggatatgttaagtaacactcacca

SEQ ID NO: 5742 - DNA, 2121 bp, Homo sapiens
cgggaacccaggcggggcgagccgcgggagagtggagggcaggcgcctgggctgggggcggggaccaggcggggcagggggcagggagaggagggcggcgggagcctgagccggaatcgcagcgtgagcaggtggagccgcgttgggagcccgccgggtcgagctgagtaaggcggcgggctcggcgggggccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatacgaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgattctgggatgctcctagtttgacctcacagtgacccttcccaatcagcactgaaaataccatcaggcctaatctcatacctctgaccaacaggctgttctgcactgaaaaggttcttcatccctttccagttaaggaccgtggccctgccctctccttccttacccaaactgttcaagaaataataaattgtttggcttcctcctgaa

SEQ ID NO: 5743 - DNA, 2138 bp, Homo sapiens
gccatggagctgctaaagctgaaccggagcgtgcagggaaccggacccgggccgggggcttccctgtgccgcccgggggcgcctctcctcaacagcagcagtgtgggcaacctcagctgcgagccccctcgcattcgcggagccgggacacgagaattggagctggccattagaatcactctttacgcagtgatcttcctgatgagcgttggaggaaatatgctcatcatcgtggtcctgggactgagccgccgcctgaggactgtcaccaatgccttcctcctctcactggcagtcagcgacctcctgctggctgtggcttgcatgcccttcaccctcctgcccaatctcatgggcacattcatctttggcaccgtcatctgcaaggcggtttcctacctcatgggggtgtctgtgagtgtgtccacgctaagcctcgtggccatcgcactggagcggtacagcgccatctgccgaccactgcaggcacgagtgtggcagacgcgctcccacgcggctcgcgtgattgtagccacgtggctgctgtccggactactcatggtgccctaccccgtgtacactgtcgtgcaaccagtggggcctcgtgtgctgcagtgcgtgcatcgctggcccagtgcgcgggtccgccagacctggtccgtactgctgcttctgctcttgttcttcatcccgggtgtggttatggccgtggcctacgggcttatctctcgcgagctctacttagggcttcgctttgacggcgacagtgacagcgacagccaaagcagggtccgaaaccaaggcgggctgccaggtggggctggaccacgtgagcaaaatctgggcgaggcggagctttggagggcgacggggcctgctggagtgggtgggactgaaatgaaggtgagggtgagaaggaagctggaaatggagttgagctgggagcggaggtcaggtggggactgggctggagactggggggactcgcctttttctctgaccgcccaccctttgtgctcaggggctgttcaccagaacgggcgttgccggcctgagactggcgcggttggcgaagacagcgatggctgctacgtgcaacttccacgttcccggcctgccctggagctgacggcgctgacggctcctgggccgggatccggctcccggcccacccaggccaagctgctggctaagaagcgcgtggtgcgaatgttgctggtgatcgttgtgcttttttttctgtgttggttgccagtttatagtgccaacacgtggcgcgcctttgatggcccgggtgcacaccgagcactctcgggtgctcctatctccttcattcacttgctgagctacgcctcggcctgtgtcaaccccctggtctactgcttcatgcaccgtcgctttcgccaggcctgcctggaaacttgcgctcgctgctgcccccggcctccacgagctcgccccagggctcttcccgatgaggaccctcccactccctccattgcttcgctgtccaggcttagctacaccaccatcagcacactgggccctggctgaggagtagaggggccgtgggggttgaggcagggcaaatgacatgcactgacccttccagacatacgaaacacaaaccacaactgacacaggaaaccaacacccaaagcatggactaaccccaacgcacaggaaaaggtagcttacctgacacaagaggaataagaatggagcagtacatgggaaaggaggcatgcctctgatatgggactgagcctggcccatagaaacatgacactgaccttggagagacacagcgtccctagcagtgaactatttctacacagtgggaactctgacaagggctgacctgcctctcacacacatagattaatggcactgattgttttagagactatggagcctggcacaggactgattctgggatgctcctagtttgacctcacagtgacccttcccaatcagcactgaaaataccatcaggcctaatctcatacctctgaccaacaggctgttctgcactgaaaaggttcttcatccctttccagttaaggaccgtggccctgccctctccttccttacccaaactgttcaagaaataataaattgtttggcttcctcctgaa

SEQ ID NO: 5744 - DNA, 1378 bp, Homo sapiens
agctgccttgcacagcctcgcaatgagctgccacaactgctccgacccccaggtcctttgcagctccgggcagctgttcctgcagcccctctgggaccacctgaggagctgggaggccctcctacagtcgcccttcttcccggtcatcttctccatcaccacatacgtgggcttttgcctgcccttcgtggtcctggatatcctgtgctcctgggtgcccgccctgcggcgctacaagatccaccctgacttctcgccatccgcgcagcagctgctaccttgcctggggcagaccctctaccagcatgtgatgtttgtgttccccgtgacgctgctgcattgggcccgcagcccggccctcctgccccacgaagctcccgagctgctcctgctgctgcaccacatcctgttctgcctgctactcttcgacatggagttcttcgtgtggcacctgctgcaccacaaggtgccctggctgtaccgcaccttccacaaggtgcaccaccagaactcgtcctcgttcgcgctggcaacgcagtatatgagcgtctgggaactgttttctttgggcttcttcgacatgatgaacgtcacactgctcgggtgccacccgctcaccaccctgaccttccacgtggtcaacatctggctttccgtggaggaccactccggctacaacttcccttggtccactcacagactggtgcccttcgggtggtacgggggtgtggtgcaccacgacctgcatcactctcactttaactgcaacttcgctccgtactttacacactgggacaaaatactgggaacgctgcggactgcatctgtcccagcgcggtgatgtggctgcggtgggtgcccctaagactcgggactgctgtgcctttcacacttgaatgaagagaaacacctgagctatatatttttttaaagcaactaacttattgctttatgtttatctatgaaaaccatagataaaatctgatgcatttttgtaatctgacaaagtaatttacatactgtttgtgtatcaatacaattttgtgttcttggtattcttagtctagctcacctcaatagccttgaatcctgcatatgaattagacattcatcactggcatatttagaatatctctaaaaggacttgtttgtagaataaggaattttctatgtttcaaagtgttctaaaacctggctaaaagaatgtatttttgtggatggtgttgacttctgactctaaaagcaatcaaacatgtttctgctggacagtgaccaagaattatagtaccttcttatatttttttatagaactgtatatttattttgaaagaaatgttattcgtgctttaaaaaggaaaaaaaaccatgaatcaaataa

SEQ ID NO: 5745 - DNA, 1791 bp, Homo sapiens
gtgaatctctggggccaggaagaccctgctgcccggaagagcctcatgttccgtgggggctgggcggacatacatatacgggctccaggctgaacggctcgggccacttacacaccactgcctgataaccatgctggctgccacagtcctgaccctggccctgctgggcaatgcccatgcctgctccaaaggcacctcgcacgaggcaggcatcgtgtgccgcatcaccaagcctgccctcctggtgttgaaccacgagactgccaaggtgatccagaccgccttccagcgagccagctacccagatatcacgggcgagaaggccatgatgctccttggccaagtcaagtatgggttgcacaacatccagatcagccacttgtccatcgccagcagccaggtggagctggtggaagccaagtccattgatgtctccattcagaacgtgtctgtggtcttcaaggggaccctgaagtatggctacaccactgcctggtggctgggtattgatcagtccattgacttcgagatcgactctgccattgacctccagatcaacacacagctgacctgtgactctggtagagtgcggaccgatgcccctgactgctacctgtctttccataagctgctcctgcatctccaaggggagcgagagcctgggtggatcaagcagctgttcacaaatttcatctccttcaccctgaagctggtcctgaagggacagatctgcaaagagatcaacgtcatctctaacatcatggccgattttgtccagacaagggctgccagcatcctttcagatggagacattggggtggacatttccctgacaggtgatcccgtcatcacagcctcctacctggagtcccatcacaagggtcatttcatctacaagaatgtctcagaggacctccccctccccaccttctcgcccacactgctgggggactcccgcatgctgtacttctggttctctgagcgagtcttccactcgctggccaaggtagctttccaggatggccgcctcatgctcagcctgatgggagacgagttcaaggcagtgctggagacctggggcttcaacaccaaccaggaaatcttccaagaggttgtcggcggcttccccagccaggcccaagtcaccgtccactgcctcaagatgcccaagatctcctgccaaaacaagggagtcgtggtcaattcttcagtgatggtgaaattcctctttccacgcccagaccagcaacattctgtagcttacacatttgaagaggatatcgtgactaccgtccaggcctcctattctaagaaaaagctcttcttaagcctcttggatttccagattacaccaaagactgtttccaacttgactgagagcagctccgagtccgtccagagcttcctgcagtcaatgatcaccgctgtgggcatccctgaggtcatgtctcggctcgaggtagtgtttacagccctcatgaacagcaaaggcgtgagcctcttcgacatcatcaaccctgagattatcactcgagatggcttcctgctgctgcagatggactttggcttccctgagcacctgctggtggatttcctccagagcttgagctagaagtctccaaggaggtcgggatggggcttgtagcagaaggcaagcaccaggctcacagctggaaccctggtgtctcctccagcgtggtggaagttgggttaggagtacggagatggagattggctcccaactcctccctatcctaaaggcccactggcattaaagtgctgtatccaaga

SEQ ID NO: 5746 - DNA, 1537 bp, Homo sapiens
atatacgggctccaggctgaacggctcgggccacttacacaccactgcctgataaccatgctggctgccacagtcctgaccctggccctgctgggcaatgcccatgcctgctccaaaggcacctcgcacgaggcaggcatcgtgtgccgcatcaccaagcctgccctcctggtgttgaaccacgagactgccaaggtgatccagaccgccttccagcgagccagctacccagatatcacgggcgagaaggccatgatgctccttggccaagtcaagtatgggttgcacaacatccagatcagccacttgtccatcgccagcagccaggtggagctggtggaagccaagtccattgatgtctccattcagaacgtgtctgtggtcttcaaggggaccctgaagtatggctacaccactgcctggtggctgggtattgatcagtccattgacttcgagatcgactctgccattgacctccagatcaacacacagctgacctgtgactctggtagagtgcggaccgatgcccctgactgctacctgtctttccataagctgctcctgcatctccaaggggagcgagagcctgggtggatcaagcagctgttcacaaatttcatctccttcaccctgaagctggtcctgaagggacagatctgcaaagagatcaacgtcatctctaacatcatggccgattttgtccagacaagggctgccagcatcctttcagatggagacattggggtggacatttccctgacaggtgatcccgtcatcacagcctcctacctggagtcccatcacaaggcagtgctggagacctggggcttcaacaccaaccaggaaatcttccaagaggttgtcggcggcttccccagccaggcccaagtcaccgtccactgcctcaagatgcccaagatctcctgccaaaacaagggagtcgtggtcaattcttcagtgatggtgaaattcctctttccacgcccagaccagcaacattctgtagcttacacatttgaagaggatatcgtgactaccgtccaggcctcctattctaagaaaaagctcttcttaagcctcttggatttccagattacaccaaagactgtttccaacttgactgagagcagctccgagtccgtccagagcttcctgcagtcaatgatcaccgctgtgggcatccctgaggtcatgtctcggctcgaggtagtgtttacagccctcatgaacagcaaaggcgtgagcctcttcgacatcatcaaccctgagattatcactcgagatggcttcctgctgctgcagatggactttggcttccctgagcacctgctggtggatttcctccagagcttgagctagaagtctccaaggaggtcgggatggggcttgtagcagaaggcaagcaccaggctcacagctggaaccctggtgtctcctccagcgtggtggaagttgggttaggagtacggagatggagattggctcccaactcctccctatcctaaaggcccactggcattaaagtgctgtatccaag

SEQ ID NO: 5747 - DNA, 2530 bp, Homo sapiens
ccgcgcctcctcggccgcctgtcgggcatgaaaaccaaattctgcaccgggggcgaggcggagccctcgccgctcgggctgctgctgagctgcggtagcggcagcgcggccccggcgcccggcgtggggcagcagcgcgacgccgccagcgacctcgagtccaagcagctgggcggccaacagccgccgctcgcgctgccccctccgccgccgctgccgctgccgctgccgctgccccagcccccgccgccgcagccgcccgcagacgagcagccggagccccggacgcggcgcagggcctatctgtggtgcaaggagttcctgcccggcgcctggcggggcctccgcgaggacgagttccacatcagtgtcatcagaggcggccttagcaacatgctgttccagtgctccctacctgacaccacagccacccttggtgatgagcctcggaaagtgctcctgcggctgtatggagcgattttgcagatgaggtcctgtaataaagagggatccgaacaagctcagaaagaaaatgaatttcaaggggctgaggccatggttctggagagcgttatgtttgccattctcgcagagaggtcacttgggccaaaactctatggcatctttccccaaggccgactggagcagttcatcccgagccggcgattagatactgaagaattaagtttgccagatatttctgcagaaatcgccgagaaaatggctacatttcatggtatgaaaatgccattcaataaggaaccaaaatggctttttggcacaatggaaaagtatctaaaggaagtgctgagaattaaatttactgaggaatccagaattaaaaagctccacaaattgctcagttacaatctgcccttggaactggaaaacctgagatcattgcttgaatctactccatctccagttgtattttgtcataatgactgtcaagaaggtaatatcttgttgctggaaggccgagagaattctgaaaaacagaaactgatgctcattgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaataaaaacccaa

SEQ ID NO: 5748 - DNA, 1580 bp, Homo sapiens
agtgagagagcggcgagggggcgcccggccggactctgagcctagtcctctcgcgctgcggccgcccgcgcctcctcggccgcctgtcgggcatgaaaaccaaattctgcaccgggggcgaggcggagccctcgccgctcgggctgctgctgagctgcggtagcggcagcgcggccccggcgcccggcgtggggcagcagcgcgacgccgccagcgacctcgagtccaagcagctgggcggccaacagccgccgctcgcgctgccccctccgccgccgctgccgctgccgctgccgctgccccagcccccgccgccgcagccgcccgcagacgagcagccggagccccggacgcggcgcagggcctatctgtggtgcaaggagttcctgcccggcgcctggcggggcctccgcgaggacgagttccacatcagtgtcatcagaggcggccttagcaacatgctgttccagtgctccctacctgacaccacagccacccttggtgatgagcctcggaaagtgctcctgcggctgtatggagcgattttgcagatgggggctgaggccatggttctggagagcgttatgtttgccattctcgcagagaggtcacttgggccaaaactctatggcatctttccccaaggccgactggagcagttcatcccgagccggcgattagatactgaagaattaagtttgccagatatttctgcagaaatcgccgagaaaatggctacatttcatggtatgaaaatgccattcaataaggaaccaaaatggctttttggcacaatggaaaagtatctaaaggaagtgctgagaattaaatttactgaggaatccagaattaaaaagctccacaaattgctcagttacaatctgcccttggaactggaaaacctgagatcattgcttgaatctactccatctccagttgtattttgtcataatgactgtcaagaaggtaatatcttgttgctggaaggccgagagaattctgaaaaacagaaactgatgctcattgatttcgaatacagcagttacaattacaggggattcgacattggaaatcacttctgtgagtggatgtatgattatagctatgaaaaatacccttttttcagagcaaacatccggaagtatcccaccaagaaacaacagctccattttatttccagttacttgcctgcattccaaaatgactttgaaaacctcagtactgaagaaaaatccattataaaagaagaaatgttgcttgaagttaataggtttgcccttgcatctcatttcctctggggactgtggtccattgtacaagccaagatttcatctattgaatttgggtacatggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgttta

SEQ ID NO: 5749 - DNA, 1638 bp, Homo sapiens
agagatctgcggaattcggccttcggaaagagcccccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgagcggaggcctcagcaacctgctcttccgctgctcgctcccggaccacctgcccagcgttggcgaggagccccgggaggtgcttctgcggctgtacggagccatcttgcagggcgtggactccctggtgctagaaagcgtgatgttcgccatacttgcggagcggtcgctggggccccagctgtacggagtcttcccagagggccggctggaacagtacatcccaagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacacaataaacaagcttcttcttcccaccctgtcctggccc

SEQ ID NO: 5750 - DNA, 2458 bp, Homo sapiens
aaatgctgagctaggggcaggaggcatgggcgggacagtgttctgtgcccccttctagagcctaaatttgttgcccgagttcctccgggaagcgctccgggtagattctgggggccgggagctgagatccctgggcggggagctggggaagggatggggctgaggacagcgaagaagagggggcttgggggaggggggaaatggaagagagaggagggaggaggtacaagaggaaggagagaagtgcggccagcttgctttctccagtcgggtggccgcggggacccgggcgacgtcggaggccctgccgggaacccaggctgcagcccccacccccgcgctgcgacacgccccccaccccttccggctcacacccccgcccacactcctgagtggtgcggtgcagcgtcggccgaggcagcagagccgaggagagcaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaaggccagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgcgccaggaggcgtggagctcagcgacacccacagggcactccagctccttcacggcggaggctacagcaagaacggggccaatcgctggtacgacaagtccctgcagtttgtggtgggccgagacggcacctgcggtgtggtgtgcgaacactccccattcgatggcatcgtcctggtgcagtgcactgagcatctgctcaagcacgtgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccatcgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 5751 - DNA, 2124 bp, Homo sapiens
tcaacgccgctctggggacgcgtcaggcccagcgcacagcctgggcagctcagcctgtcagctgagcacgggcgcctcaaggggtgcggccctctcagaaggaaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaaggccagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgcgccaggaggcgtggagctcagcgacacccacagggcactccagctccttcacggcggaggctacagcaagaacggggccaatcgctggtacgacaagtccctgcagtttgtggtgggccgagacggcacctgcggtgtggtgtgcgaacactccccattcgatggcatcgtcctggtgcagtgcactgagcatctgctcaagcacgtgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccatcgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 5752 - DNA, 2286 bp, Homo sapiens
cccgccccgttgaggctttgagaaaggagtaggagccgagcattccggcagaggaagaaaaacggcccatcttttagagtccgacctctggaaattcgggtggccgcggggacccgggcgacgtcggaggccctgccgggaacccaggctgcagcccccacccccgcgctgcgacacgccccccaccccttccggctcacacccccgcccacactcctgagtggtgcggtgcagcgtcggccgaggcagcagagccgaggagagcaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaaggccagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgcgccaggaggcgtggagctcagcgacacccacagggcactccagctccttcacggcggaggctacagcaagaacggggccaatcgctggtacgacaagtccctgcagtttgtggtgggccgagacggcacctgcggtgtggtgtgcgaacactccccattcgatggcatcgtcctggtgcagtgcactgagcatctgctcaagcacgtgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccatcgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 5753 - DNA, 2114 bp, Homo sapiens
cccgccccgttgaggctttgagaaaggagtaggagccgagcattccggcagaggaagaaaaacggcccatcttttagagtccgacctctggaaatgtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaaggccagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgcgccaggaggcgtggagctcagcgacacccacagggcactccagctccttcacggcggaggctacagcaagaacggggccaatcgctggtacgacaagtccctgcagtttgtggtgggccgagacggcacctgcggtgtggtgtgcgaacactccccattcgatggcatcgtcctggtgcagtgcactgagcatctgctcaagcacgtgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccatcgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 5754 - DNA, 2528 bp, Homo sapiens
aaatgctgagctaggggcaggaggcatgggcgggacagtgttctgtgcccccttctagagcctaaatttgttgcccgagttcctccgggaagcgctccgggtagattctgggggccgggagctgagatccctgggcggggagctggggaagggatggggctgaggacagcgaagaagagggggcttgggggaggggggaaatggaagagagaggagggaggaggtacaagaggaaggagagaagtgcggccagcttgctttctccagtcgggtggccgcggggacccgggcgacgtcggaggccctgccgggaacccaggctgcagcccccacccccgcgctgcgacacgccccccaccccttccggctcacacccccgcccacactcctgagtggtgcggtgcagcgtcggccgaggcagcagagccgaggagagcagtgagggaattcaccctactccacaccagagatgtggccggaatgcagagatgaagcactgagcacagtaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaaggccagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgcgccaggaggcgtggagctcagcgacacccacagggcactccagctccttcacggcggaggctacagcaagaacggggccaatcgctggtacgacaagtccctgcagtttgtggtgggccgagacggcacctgcggtgtggtgtgcgaacactccccattcgatggcatcgtcctggtgcagtgcactgagcatctgctcaagcacgtgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccatcgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 5755 - DNA, 1839 bp, Homo sapiens
gcggtgcagcgtcggccgaggcagcagagccgaggagagcaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaaggccagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgcgccaggaggcgtggagctcagcgacacccacagggcactccagctccttcacggcggaggctacagcaagaacggggccaatcgctggtacgacaagtccctgcagtttgtggtgggccgagacggcacctgcggtgtggtgtgcgaacactccccattcgatggcatcgtcctggtgcagtgcactgagcatctgctcaagcacgtgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccatcgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccagctgtgttggccatagatggacatgaggtcatcctagagaagatagaagactggaatgtggtggaactcatggtgaatgaagaagtcatcttccactgcaacattaa

SEQ ID NO: 5756 - DNA, 2964 bp, Homo sapiens
agtgtgcctttgtgagggtgtgtgtgccgccgggtctgtgcagtgggtgtgggtgtttgtctccctgtatccgccttctctcccgtccgggacttttagccttcctgggctcgccttcctcatgtcctttctcctccctcttggggctcaaattgggtgccctggtgaaggaggggggcacactccagaacctagtccaaccccagacgctgcctgaggcttccctccagctcccctcccttccttttctccctttcctccctccctctctttccctttctccctccccgctaaggctggcgtgccagggggtgggacatgccaatcactggctgtgcctctcccgctgccagcacagggcgcagctccccctgggagccaggtgtttgggtccctggagacgccgcaggcccccagggaggcagtggggctgaggaccctacagacccctcttcagccccgtggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacagtgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcggctcggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgcactccctcccgccaatgctgatagtcccctctcctgcatccctccaccccagtccccgggaaaggccggtgggaagagggcaggggctgcatcctcagccccagggccctgctcaggcctcacctggcttcccaggaccctgggtcaccttcctgggcagcccagagagaccctgccaactttccagacttcgctattcccaggcagggagggaaacccggggaactggtttttctgttccctgctgggtgggaatgcgctcttcaccaggaagaaggcccgggaggaggatccgggctttggactccttgtttgcctttaggcaggaagtcaggagccagcagggcgggccaggagaaagaaggcttaacattaagtattccttggcccagcagcggcccagattgcggtgtgagatggtgccccctggggggcacagccagaaactgaactggccgctgggagaaaagccagatgacagggagctggggaatcccctcgcttcataggcagagcccgcccacctgggccctaggcatactctccaggattgtccacaaatgtcctcagagggtccctaggtgggtcaactccaaggcaaatgtccaagcatcagcaagacaatgacactggaagggtccggcttggctagtcacatatcaagtcccgaggcagcaacaggaccaggagccaggtgtcctgactgtcctacaatatcattttcctgggagtgggagtcaagtgtgcctgctatccagccgcaaatccataccccctgccccagagaagcctcagtccctccctcctggctcacagccaccacctggatggatctgctccatgcagatctagccaggcctcccgcatgctgcctgcctccggccctgccccacacaggcctggcccagccagcaggttctctcctgtgagctccccaatccaacccatgcatggcctcccagccacccggatctccaggcccagcctggccccaaatgttctttcctttcatcctcagcaagtgctgagtctgtgaataaagccacataaccagcgggca

SEQ ID NO: 5757 - DNA, 549 bp, Homo sapiens
cggtggcaagaatcaggttccaattctctggaacctctggtgacttctctacctgccacctgccccaggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtg

SEQ ID NO: 5758 - DNA, 2123 bp, Homo sapiens
atgtgcaggggggagggcgtgtgtgcgagggaagcaggcatgtgaataccagggcatgtgtgttggggcatggtgcacaggggctgggggctctaaggttgggtggggggaggagcccaaggaaacagtgtgcctttgtgagggtgtgtgtgccgccgggtctgtgcagtgggtgtgggtgtttgtctccctgtatccgccttctctcccgtccgggacttttagccttcctgggctcgccttcctcatgtcctttctcctccctcttggggctcaaattgggtgccctggtgaaggaggggggcacactccagaacctagtccaaccccagacgctgcctgaggcttccctccagctcccctcccttccttttctccctttcctccctccctctctttccctttctccctccccgctaaggctggcgtgccagggggtgggacatgccaatcactggctgtgcctctcccgctgccagcacagggcgcagctccccctgggagccaggtgtttgggtccctggagacgccgcaggcccccagggaggcagtggggctgaggaccctacagacccctcttcagccccgtgggcaccctgaaacccaccacccccgtccacctcagctcccccaagatggactgaatcaggctgctggccagatagagaagctagaagccaaggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacagtgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcggctcggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgca

SEQ ID NO: 5759 - DNA, 1694 bp, Homo sapiens
acagactagccaagtggctgagacgagtgtggggtgcgtgactctgcctgcgcgcgcgccagccccgcagctctcgccagagccttgggatcaagggagaaagagaaccggcagctggcctcggactctaagcggtgcgcagctccagcccgagcggatcggccctgaacccacaaaggactcctcgctccttcaagcctccaccacctcgcagccggggaggcaactggagcgaaaccagcgacaggtttaaatgtttatttgctacttggctactgattagagaacgcaaaatgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaa

SEQ ID NO: 5760 - DNA, 2530 bp, Homo sapiens
acagactagccaagtggctgagacgagtgtggggtgcgtgactctgcctgcgcgcgcgccagccccgcagctctcgccagagccttgggatcaagggagaaagagaaccggcagctggcctcggactctaagcggtgcgcagctccagcccgagcggatcggccctgaacccacaaaggactcctcgctccttcaagcctccaccacctcgcagccggggaggcaactggagcgaaaccagcgacaggttgttagcgacatgagtacagggtctggatcttacccattcaagagtgtattctcagcacccaatgcctggcatatagtttaaatgtttatttgctacttggctactgattagagaacgcaaaatgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaaaatatctttgaaaaagatagaaggtgggcaaggggagcttgagaagaataaaagggataaacgagctcctagttttaaaatctctgccattgcactttatagtctgattacaaaacgtgcaattcaggagcccagcagtgacacacttatcacgcctaggctccagtttgcaaaaattgcaccttataaactgtcagtattaggagcaatgagacaatgaaagaaacatgttgggatcgtggatttaagaaactatacactgtttctcataatctcttgaagaagggcttctgattctacaattttatcagtctctgcacaagaggaataaccttgttccttttttgttacttttgttgttgttgttctcatgtgtccttaagagaaggaaatgccacagttacaaggtaaacatggagacttaaacataaagaaataggcactatacaatggggacataaaaaaagaaaatcaaagaaggatgcagaaattgtctccggagtgttaagcatattttattcttttgttacggtcctatttagaggattggaatgtaataaatgcttattttttgcctttctttttcccaccatgaagagaaagcaaacaaacagaaaccccaactaggtcacaccatttttcttcttgttatgccactattttgtacatccctgttctatattgtttatagggaaaacctacaggactttcactaaagctagccagagacagccatgaaaatggacgtttcacccctc

SEQ ID NO: 5761 - DNA, 2571 bp, Homo sapiens
gtgactctgcctgcgcgcgcgccagccccgcagctctcgccagagccttgggatcaagggagaaagagaaccggcagctggcctcggactctaagcggtgcgcagctccagcccgagcggatcggccctgaacccacaaaggactcctcgctccttcaagcctccaccacctcgcagccggggaggcaactggagcgaaaccagcgacaggttgtccaggctgatcttatactcctggcctcaagtgatcctcctgcctcagtctccaaaagcactgggaatacataggttgttagcgacatgagtacagggtctggatcttacccattcaagagtgtattctcagcacccaatgcctggcatatagtttaaatgtttatttgctacttggctactgattagagaacgcaaaatgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaaaatatctttgaaaaagatagaaggtgggcaaggggagcttgagaagaataaaagggataaacgagctcctagttttaaaatctctgccattgcactttatagtctgattacaaaacgtgcaattcaggagcccagcagtgacacacttatcacgcctaggctccagtttgcaaaaattgcaccttataaactgtcagtattaggagcaatgagacaatgaaagaaacatgttgggatcgtggatttaagaaactatacactgtttctcataatctcttgaagaagggcttctgattctacaattttatcagtctctgcacaagaggaataaccttgttccttttttgttacttttgttgttgttgttctcatgtgtccttaagagaaggaaatgccacagttacaaggtaaacatggagacttaaacataaagaaataggcactatacaatggggacataaaaaaagaaaatcaaagaaggatgcagaaattgtctccggagtgttaagcatattttattcttttgttacggtcctatttagaggattggaatgtaataaatgcttattttttgcctttctttttcccaccatgaagagaaagcaaacaaacagaaaccccaactaggtcacaccatttttcttcttgttatgccactattttgtacatccctgttctatattgtttatagggaaaacctacaggactttcactaaagctagccagagacagccatgaaaatggacgtttcacccctc

SEQ ID NO: 5762 - DNA, 2474 bp, Homo sapiens
acagactagccaagtggctgagacgagtgtgggatcaagggagaaagagaaccggcagctggcctcggactctaagcggtgcgcagctccagcccgagcggatcggccctgaacccacaaaggactcctcgctccttcaagcctccaccacctcgcagccggggaggcaactggagcgaaaccagcgacaggttgttagcgacatgagtacagggtctggatcttacccattcaagagtgtattctcagcacccaatgcctggcatatagtttaaatgtttatttgctacttggctactgattagagaacgcaaaatgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaaaatatctttgaaaaagatagaaggtgggcaaggggagcttgagaagaataaaagggataaacgagctcctagttttaaaatctctgccattgcactttatagtctgattacaaaacgtgcaattcaggagcccagcagtgacacacttatcacgcctaggctccagtttgcaaaaattgcaccttataaactgtcagtattaggagcaatgagacaatgaaagaaacatgttgggatcgtggatttaagaaactatacactgtttctcataatctcttgaagaagggcttctgattctacaattttatcagtctctgcacaagaggaataaccttgttccttttttgttacttttgttgttgttgttctcatgtgtccttaagagaaggaaatgccacagttacaaggtaaacatggagacttaaacataaagaaataggcactatacaatggggacataaaaaaagaaaatcaaagaaggatgcagaaattgtctccggagtgttaagcatattttattcttttgttacggtcctatttagaggattggaatgtaataaatgcttattttttgcctttctttttcccaccatgaagagaaagcaaacaaacagaaaccccaactaggtcacaccatttttcttcttgttatgccactattttgtacatccctgttctatattgtttatagggaaaacctacaggactttcactaaagctagccagagacagccatgaaaatggacgtttcacccctc

SEQ ID NO: 5763 - DNA, 5918 bp, Homo sapiens
acacacgcacgaatacagacacgctctcctgctgtactaaaggcgccagggcgcaaagacctagggagcgcgcgcgggcacacacacacacacacacacacacacagacacacacacactcacacactccaggctgcgggttggccagagcctggaaatcgcagatttcaccaggaaatcgccgaggtacccgaataggtgttgcctcccaaaactaattcctacttccccaagcactttggtgaagaaatgaatccagcccagctcgccgaggcatccaggtctccattctattttggtctccaggctcttcgtgaaagccagatcaagggagaaagagaaccggcagctggcctcggactctaagcggtgcgcagctccagcccgagcggatcggccctgaacccacaaaggactcctcgctccttcaagcctccaccacctcgcagccggggaggcaactggagcgaaaccagcgacaggtttaaatgtttatttgctacttggctactgattagagaacgcaaaatgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaaaatatctttgaaaaagatagaaggtgggcaaggggagcttgagaagaataaaagggataaacgagctcctagttttaaaatctctgccattgcactttatagtctgattacaaaacgtgcaattcaggagcccagcagtgacacacttatcacgcctaggctccagtttgcaaaaattgcaccttataaactgtcagtattaggagcaatgagacaatgaaagaaacatgttgggatcgtggatttaagaaactatacactgtttctcataatctcttgaagaagggcttctgattctacaattttatcagtctctgcacaagaggaataaccttgttccttttttgttacttttgttgttgttgttctcatgtgtccttaagagaaggaaatgccacagttacaaggtaaacatggagacttaaacataaagaaataggcactatacaatggggacataaaaaaagaaaatcaaagaaggatgcagaaattgtctccggagtgttaagcatattttattcttttgttacggtcctatttagaggattggaatgtaataaatgcttattttttgcctttctttttcccaccatgaagagaaagcaaacaaacagaaaccccaactaggtcacaccatttttcttcttgttatgccactattttgtacatccctgttctatattgtttatagggaaaacctacaggactttcactaaagctagccagagacagccatgaaaatggacgtttcacccctcctcactgtgtcctttgcattcgttggggatatcaaggtctataaggatttagtgcacttataatcctatatgcgaaatgtttaaaccaatctgattttctcctaaatagccttttatatcaacagaatatcctacctaaaacataaacctgtttaagaaaccatcgtcactgtaaagttgaggtttcatcaaattaaataatggactatctagttggaccaagtttattaaagtcaggtgaattttaagattaaaaaatagaagtttaggactttctatttcaacctgaatttgcctgacccatgtatgaaatgttaacttatagaaaatgaactcctgactttctcagcagaaaggaatgctgttttatttatttggaatcctaaacaggattaacatactcacatagcaccagtgatttctgggccagtccctagagaatagaaccttctatccaatgcctgctaaaggatgatattcaaattataaccaagtgaggatgtctgcaattatcctatgaccccatgaaaggggaaaaaacgatattttaaaaactattactgaaacaattacatattccatattcctcaaattgtcaattctccctaacattatttaacttcaaaattctcttatcaatagaattatagtaatctttgtgacagaaatgtagtggctaactaaatagaggccaaacgagcttacagaatctgacagaaggaggtaggtggctgttgccatgccacatctcaccatctaattctagaccataataatcatgtcaggaactattatctaagtggtggcattatatagaatcttgccacgtagagattttttatttggtcgtctaaataaatataggattaggattatacggattcacatacaactagttatttttatcctttatatttttcttacagtatttgctgtagttttccaatgagattttctaaaaatggctcaatcaatggaaatcaaattataaacgcatttgcaaatttcatattttggattttagatttatgatatcttgttcagtaataataatgttagttacatggtaaatttatcaatattagaccccagcacttaaaagaattattttgtatgattagcctcatagatgccacctcaacattttggagagttaaggaggaaaaaaagcatgagggaaaaaaaaaaccaaaaaacttataagttagtaagaagcaaattgccagcagtatttatatttgacttatccttcgtaaaaacaatttcctgtttaaataacttcagtcattacccccccaaagtaatcttccatatttaaagcattcatttatagagattcccttacctacagttacttcaacatgcacttttacattttaaattcatatttattttcatattgtttcttcaaatgaaggaatcagttgaacggaaataacgtcaagccagtgggctcctcgagtttctgaaaaccagagaattgactagccaagtatttccctttttaatgtattgtattattattatgtagatttggcttcagttgggaagaaccctttggcatccaggattcaggattcagggtctttttttgtttgctctaataatccaacgcaccatgaatcaagcttttagtctctgctgccattgtatccttccttttcctccctctgttattgatccttgccacagccactgcaacctcattgaaagagaaactgtcactttaaagaaagaaattgaagataggctgacaccatggaaactacgtcaaacagataagaaaaatggaaggaatactgaaaatgatagatgattggagagatatggagattatattcaaggatttttattaaccactgctggatttgtctatttcagtggctctcaaacagagacaattcccctctccccgaaaggggacacttagcaatgcgtaaagacatttttggttgccacactgggaggaatgctattggtatctagtgcatagaggctgggaatgctgctaaatagcctataatgctcaggacattttcccccaacccctttaaacaaatattatttggctcaaaatgtcaatagttccaagattgagaaattcttgtctactttaagggatttctaaagcttgcctcttattagtgggaaaataaccctgcattatttttagaatatcaatgcaaattcctcacctgttagaaaaaggtaatactcaccaaccatgtatcagaaaaacttttctcctgagtctggtgtatgtgtcagtcacagattgggaactcaggccacatctacatatcaaaaatcaccagactatgcatatcgcacatcttttttccagcatcttaatgttcaattatgattgccacagatctagtcaattgaggttgcagtagttggccatcaaaatatttgcagttgatatgatcagtttctactggagctgcaatttttcctttcaaaaaatattaagagcctctttcagaaacaatatcatttatcttctttgcatttactggaaaggtgtatctgtaaggtctttgttttttctctcctcatagcaataatgtagctatcccagagtgatattataagaagaggagattaagaatatggaaaaagtctgttcatttcttcgaaacaagaaatgattttccttttaccagttcatcattaatttaacgccagctcccaagtattagggcagagtaatcaatatgagaagccacaacgggtaagctttctgatttgaaatgtacaagctggatgtccaacatactcctgctctttgttcatttgcttttttgatcctgaagatctgacattgggagagatgggaattcaaaatgatggcaacaattactcagcaatgcagtctgtttttattttctcctacttagttcattgacagtttcctcctcgccccagtttgataatatccctttcaacaaccatagtaccggtgttgcaaatagtttaggaaagcacccaaagctggatgaaattgtgcaaagtgtattctcagcatgtatattcaataccatgcctcttaaaaatgcttctcttaaagggtgcacgctgtagcatgaaatgtgtgcatatttaatgtatcttcctggaatatgctatgtgctaaatatatatatattctataaataaaataataaaatgtacaatagaaatacatatttctgtatgcaaataaatatattatacacaaactcttaa

SEQ ID NO: 5764 - DNA, 2014 bp, Homo sapiens
acagactagccaagtggctgagacgagtgtgggatcaagggagaaagagaaccggcagctggcctcggactctaagcggtgcgcagctccagcccgagcggatcggccctgaacccacaaaggactcctcgctccttcaagcctccaccacctcgcagccggggaggcaactggagcgaaaccagcgacaggtttaaatgtttatttgctacttggctactgattagagaacgcaaaatgaataactcaacaaactcctctaacaatagcctggctcttacaagtccttataagacatttgaagtggtgtttattgtcctggtggctggatccctcagtttggtgaccattatcgggaacatcctagtcatggtttccattaaagtcaaccgccacctccagaccgtcaacaattactttttattcagcttggcctgtgctgaccttatcataggtgttttctccatgaacttgtacaccctctacactgtgattggttactggcctttgggacctgtggtgtgtgacctttggctagccctggactatgtggtcagcaatgcctcagttatgaatctgctcatcatcagctttgacaggtacttctgtgtcacaaaacctctgacctacccagtcaagcggaccacaaaaatggcaggtatgatgattgcagctgcctgggtcctctctttcatcctctgggctccagccattctcttctggcagttcattgtaggggtgagaactgtggaggatggggagtgctacattcagtttttttccaatgctgctgtcacctttggtacggctattgcagccttctatttgccagtgatcatcatgactgtgctatattggcacatatcccgagccagcaagagcaggataaagaaggacaagaaggagcctgttgccaaccaagaccccgtttctccaagtctggtacaaggaaggatagtgaagccaaacaataacaacatgcccagcagtgacgatggcctggagcacaacaaaatccagaatggcaaagcccccagggatcctgtgactgaaaactgtgttcagggagaggagaaggagagctccaatgactccacctcagtcagtgctgttgcctctaatatgagagatgatgaaataacccaggatgaaaacacagtttccacttccctgggccattccaaagatgagaactctaagcaaacatgcatcagaattggcaccaagaccccaaaaagtgactcatgtaccccaactaataccaccgtggaggtagtggggtcttcaggtcagaatggagatgaaaagcagaatattgtagcccgcaagattgtgaagatgactaagcagcctgcaaaaaagaagcctcctccttcccgggaaaagaaagtcaccaggacaatcttggctattctgttggctttcatcatcacttgggccccatacaatgtcatggtgctcattaacaccttttgtgcaccttgcatccccaacactgtgtggacaattggttactggctttgttacatcaacagcactatcaaccctgcctgctatgcactttgcaatgccaccttcaagaagacctttaaacaccttctcatgtgtcattataagaacataggcgctacaaggtaaaatatctttgaaaaagatagaaggtgggcaaggggagcttgagaagaataaaagggataaacgagctcctagttttaaaatctctgccattgcactttatagtctgattacaaaacgtgcaattcaggagcccagcagtgacacacttatcacgcctaggctccagtttgcaaaaattgcaccttataaactgtcagtattaggagcaatgagacaatgaaagaaacatgttgggatcgtggatttaagaaactatacactgtttctcataatctcttgaagaagggcttctgattctacaattttatcagtctctgcacaagaggaataaccttgttccttttttgttacttttgttgttgttgttctcatgtgt

SEQ ID NO: 5765 - DNA, 8778 bp, Homo sapiens
gggcaatggcgggcgcccctcccccagcctcgttgccgccttgcagtttgatctcagactgctgtgctagcaatcagcgagactccgtgggcgtaggaccctccgagccaggtgtgggatatagtctcgtggtgcgccgtttcttaagctggtctgaaaagcgcaatattcgggtgggagtgacccgattttccaggtgcttccgtcacccctttctttgactcggaaagggaactccctgaccccttgcgcttcccaggtgaggcaatgcctcgccctgcttcggctcgcgcacggtgcgcgcacacactggcctgcgcccactgtctagcactccctagtgagatgaacccggtacctcagatggaaatgcagaaatcacccgtcttctgcgtcgctcacgctgggagctgtagaccggagctgttcctattcggccatcttggctcctagtatttttaattaagcacttgtgttctgattagtggccaaataaatgacagtcagaacttcagctaaggtacaataaggttttgctgtggcgtggcacctggtctctttctagaaggaaagttcaacatacagcacaattctggacacattgtattggtttgatgctcctacctggaacaggtggagctggtctcttgggcagcctgacatctggtccactcctctgtcctatgccgggatcatcatgaccgtagagattatgtcactgttttgcatccttgttacataactcagttcctggtagattactatgtcagagagtcacaatgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcctggcctgtgccgatctgattatcggggtcatttcaatgaatctgtttacgacctacatcatcatgaatcgatgggccttagggaacttggcctgtgacctctggcttgccattgactacgtagccagcaatgcctctgttatgaatcttctggtcatcagctttgacagatacttttccatcacgaggccgctcacgtaccgagccaaacgaacaacaaagagagccggtgtgatgatcggtctggcttgggtcatctcctttgtcctttgggctcctgccatcttgttctggcaatactttgttggaaagagaactgtgcctccgggagagtgcttcattcagttcctcagtgagcccaccattacttttggcacagccatcgctgctttttatatgcctgtcaccattatgactattttatactggaggatctataaggaaactgaaaagcgtaccaaagagcttgctggcctgcaagcctctgggacagaggcagagacagaaaactttgtccaccccacgggcagttctcgaagctgcagcagttacgaacttcaacagcaaagcatgaaacgctccaacaggaggaagtatggccgctgccacttctggttcacaaccaagagctggaaacccagctccgagcagatggaccaagaccacagcagcagtgacagttggaacaacaatgatgctgctgcctccctggagaactccgcctcctccgacgaggaggacattggctccgagacgagagccatctactccatcgtgctcaagcttccgggtcacagcaccatcctcaactccaccaagttaccctcatcggacaacctgcaggtgcctgaggaggagctggggatggtggacttggagaggaaagccgacaagctgcaggcccagaagagcgtggacgatggaggcagttttccaaaaagcttctccaagcttcccatccagctagagtcagccgtggacacagctaagacttctgacgtcaactcctcagtgggtaagagcacggccactctacctctgtccttcaaggaagccactctggccaagaggtttgctctgaagaccagaagtcagatcactaagcggaaaaggatgtccctggtcaaggagaagaaagcggcccagaccctcagtgcgatcttgcttgccttcatcatcacttggaccccatacaacatcatggttctggtgaacaccttttgtgacagctgcatacccaaaaccttttggaatctgggctactggctgtgctacatcaacagcaccgtgaaccccgtgtgctatgctctgtgcaacaaaacattcagaaccactttcaagatgctgctgctgtgccagtgtgacaaaaaaaagaggcgcaagcagcagtaccagcagagacagtcggtcatttttcacaagcgcgcacccgagcaggccttgtagaatgaggttgtatcaatagcagtgacaaaacgcacacatcaacccacagaccttaggaggaggaaggcgagggcggggtgacttctggtgatgataaaaatggttttatcacccagatgtgaaagaagctgcctgtttactgatccattgaataaacccattttaatagaaaaagtcaataccaattcagcaaaaagaaaaaaaaaacatactactgaatataaagaaatttattctgaaatagactttacgtgtttttttcttaaagaggagaaaaatattgcttgacggcaattatatacccaaagtgatttgcctgggtcctttaattcccattagctttggaatctcagatgagcatagctgacccagttcccacattcttcccaaggatcccaaaagtgggaatccagaccccaagtggaacactgcaggcttacgaatctgtggttccaaaattatttcatacgttgcaaagctgaatcttcttgtcccaatagagcttcctgtcttttctttggtgtgttgttaaactctatttgtggacttgattcttgattcttgcaaagtactgttttgtgcagttcaagtttcgtacaaataaaaatacttaagtatatatatatgtgtgagttctgcacgcacacacatagtgtatataatatcatgggaaacactgaactggcaaattattcctgcaacatacgctttcagtactttggtaactgaagttctctaggatcctaatgcaacattaacgtgaaataagcccagtgtaatgtttttgaaaccagggctgttttccacagagagcagccaggccttcccagcaggtctgtgcagagcggacaggctcgtgagtcagctgagcgccgtggcttcgccagacttggtgttaagcaacctcctttgttgatgtctcaacagagctaaatcggggcccctctgagctcaaagaatgaaccacatccacacgtttgaatttaatcatctaaatctgaatgtttcagaacaaaatttctgctatctaaactgcttgaaactcaataatagtgtcacgtttgaatgtcatacacagcaatatatatatatgtgtatatatatatatatggcaaagcaaaaaaaaaaacatggtaagagagaatgaaggagaacattgtgtttgattcttgctgaatggcaccttctcaaagaaaatagggcttgcacctttgttaatcagctgtggccagtgctttctggtgttcattgtgtaaccttcacccaggaataggtgaggttttaggaagttacatgtcctctgaagaaagaattacactctgaaaagtaatgcttcaaattgatttccttaccttttgggaaaaaaaaaaaattgtttttttgcattctcccttgaattgaccaaaatgttaactgtttcatttggggaggggatggggtgctgccatcattgtcgttgttgttgctgctgtagctgttggggtttcttttcctgttgccggggctgtttggggagagggaggggagggaggtgggagggccgcggagatatcttccctttgtacagggcattcgtgttgtgaacccagagctgggtagaagctgcttttgtattcagtgtgaggtggtgtttacagacgactttgacaacagtagaagtgtactcagtggtgtctgtgtatctgaactatttaatttcgtgttatgtttatatgcagaaatatttatggatactacaccaagtgtttatttaatgttgataaatatgactcttcagtcgtcagccatggtgtcctttcaaagtgattctttaaggtccacttgagcaatgaatagagtatattggagctttcctgtggctaagaagaagaaacatgtcatcctgttggcatcaccaagcacctaactctttctaggtaataaaaagtcaacggtcacttcaacgtaaatgtttaaaaccactctttagttaaatctgatgggaactgaacaaagctccaccattgtgtctgaaatcattttacacagggaaaaaaaaaaacaatcagcataattgtaagaatgatttttttgggcccacattcaaccaaagaacaagaaagaaacagacgattttctaatatgtacacagcaaactacagaatgtcatattatccacctgtgaaacatctagtaagcaattgcatctatattttatttctcaagttggcctggcactaataaatatgtgaaagcttattcaagtgtcccagtacttcagcacttcccatccttttggaaactcctatcttgcctccctcccaaaagggctgtttcttttattaaaaaaaaaaaagaaatagaattaaatttgagaaaaggagaaaccctgaaatttaacagaactttgagagtcacttccaatctccttaaacatgattatctccttatccttgtccttttgtgatgctaataatagcagaaaaggaacaaatccaagactctaggtctcccttttttgttttactggttttattatagaattgtttttaagcctcttatggatgaaagctgcatttaaatactatctactgattttatagaaaggtatgtccatttcttgggtcactttcagagaaagaaaacaagcaaaataggttcttttgaatatgaataatttaaaagcataattgaagatgtagtgagtatttataattggaccttagttacacgtgcatttctcaaagggcttgtcattacaggagatattcagcacttacctaagatcaaaatgtcttcatcccaaattgggaatcgaattatttcatgccatatgcatgaggtttgcagacatttcaagattagccactttgcttgaaagaagaaaatgatcaaacctaaaataaactacacatggagaatctctctctctctctctgcctctctctctctctttctccctcttcttccttctctctctctcacaagcacacacacacacactcaatctccattctccaggcattgccagatggttaggagaagtgagctctctctggtcccctagatccctcggctctgctctcctttgcccatcagctccctgtggcctctatgctagtcctccctattctcctagtcaccctttgcctcttaagcccagccttgactctctacatatttttcatttctctttaccctttagtgtacaatagttgtagactctgacggaatgaaaacaaacaagaagcctaagcgttagaccctgctgtggctaaagatctagaaggcatatcagttttctctgtcaggcttcctacgttgccctcgtgcagggctcattgctctgcagagcgctggaagccccttcatgtatcgagagagaagctggagcacagagctctgatgcacagttggctgtttcagctctgactcagggaggaaagaaggatgccaaggctctgtcacagcggagaagtctaataccagagtggcacagagaaggattccagggatcagtcagggtgtcctgtacctatctgagtagagatgattcaaggatggggacatattccaggaaattgcacaatcttcccctggcagcttcagaggacgagtgaaaatagtgcagtatagtcaaagaagcaatgaatttaggatgaggaacctgaagtttctggaccagtttggtcactgcttagttacatgtccttaggaatgcttgtcacttaacctaaactttctgggttttatcctcattgctcaaactaagcaacaacaccgaagcttctctaatttgccttctgatgccaaatcggtcaaaactgaggtcagcagctaccatgacgaaagtaaaatggtatattgggtgaatgtttgaaaatttcagattttatattctgtaaagttatttacttactctatttcaacaccacaaaatcttgaaatttggaaggtaaccaaggaagctttgaaatttgttggcaaacccggagtagtatggtttcaaataccactccaacccagcacctgaggtcgggcaaactcacaaaatagagtttctaggtagcaggtgtttgctttggttttgcaatagcatttctcataacagaactgaaactgtatagattacaacactccaaagttatttttttttaacctaaagaaccctacttctagcacctcctctgaaagaatattttgctccaataccacgtgcaacaaacttatttagacagtatcaactctagcccttaataggttcaaggacaagtttactgcttcctttctacacgcttaagttacactctcttctcctgttctgatgactctaaatcttcagcctctcccagcattaatgtgtgagtcaacattgcagacctgagaaaggtttctagaatggtaacccaatgttctttagaactggagaattccattttccttttctggctttagtgttaatgtctgggaagggaggctcatgataagaaaataaaaatgagaaaagaagatctagttcataaaatgactataccccacgtaagtttgtaactgcacagtgttttgttgtacggctcagaaatgagcaagtgttagtattattaggcacacatcacgttcacagcttcgcgcagagacggatagtgtatttggatatatggaagtcatccaaatgcgttgctagaatatcaggcctatgtttgttctggtagaaccacagagactcacacaaagttctgaccctaccactctggtctgggctgagaccaccccaaaaaatcatctagagaatcaaaggggctcacatctcagttgcattctatttaaaagataaaggggccatactctccactgcaaagaagcattagtaaaacttcccgcacccaaattataatccggcaaccctagcttcagctaaaaagattatccccagaatctaaaagcttactattgttctttcttggagtccaaaatgcttagcagttctgcagttcacatacaaaactcaaaactctttttatcctgtattctgtgagttccttgatgatagtaattgggtcttattcatcactctgtatcctgtggctcacacagaatctggcaaattgcatatattcaataaatgttgaatatctaataacctccttattaatataacaaatattatcaacattctgtgcacatcaatgtcccatgctgctactgtagtcaggagttatttggctgggaagtggaaagtgttcacaaacatgatgcttatctaataaaatatcactgagcaataaggagaaatattttaaatagatttgaagttgtgaacaaataatttagagtccaaagaggaaaaagaaaattaactctgttttttatccctagaactcagaaactttactggattggtcaacaaagacaaactttttattgtataaaacagtagaattcatggaagggataattcttttggaacaggcttctcggttacttgccttagtaaaagaagtatctggagggcctggagagttcataaacatagttttctgtgcaagtgaagatctgtagtttggcttaaaaatccttgcatgtagttttgcttggcgtggaaagttattaggagacaatcctttatcctgttctgcaagcaatcaaacacatgatctcccttctagccattcctcatccagtacatgggcatttccagcctcctacatgtaacacttcaaacttcctctgggcgtctgcttagagctatgtgatggccacagtttgggcaaagcccttctttcttttaaatataggaactgttaccaagtttggtgcaggcttgaggaataattacataaaaatgggcttccacgatggtgaatcagcatgctgatttctcttggcaggaagctctcagggaaatgtctgtgaatcatttaaagatgctctctggtggatagagaaaccgcagtccaaaaacagatgggtgtatatttgctttgtaagcaaagggcatgtatcatactcgcatctaaaacagtgtccacatctttgccaaaggcactgaattttacctttttttattacctcgtggccagcacttcctcagtaggcatttcaggtgtgtcacaaaccatgttcatttttaatcttgaaaaagtcaatcgtctgtagtctgtactataaaatgatgcctgcaactttgtggtgaatattatccccaagttaacagtgaaataagtaaataaaactattattgaacaaa

SEQ ID NO: 5766 - DNA, 587 bp, Homo sapiens
ttttagtacggtattgttgcagctgacctgtatacgtaaggaattactgggtcatcagctctggggaatgtcttttgattatgaacacattttcagcatgtgtccactgaaggtggagctggtctcttgggcagcctgacatctggtccactcctctgtcctatgccgggatcatcatgaccgtagagattatgtcactgttttgcatccttgttacataactcagttcctggtagattactatgtcagagagtcacaatgaccttgcacaataacagtacaacctcgcctttgtttccaaacatcagctcctcctggatacacagcccctccgatgcagggctgcccccgggaaccgtcactcatttcggcagctacaatgtttctcgagcagctggcaatttctcctctccagacggtaccaccgatgaccctctgggaggtcataccgtctggcaagtggtcttcatcgctttcttaacgggcatcctggccttggtgaccatcatcggcaacatcctggtaattgtgtcatttaaggtcaacaagcagctgaagacggtcaacaactacttcctcttaagcct

SEQ ID NO: 5767 - DNA, 1468 bp, Homo sapiens
atggccaacttcacacctgtcaatggcagctcgggcaatcagtccgtgcgcctggtcacgtcatcatcccacaatcgctatgagacggtggaaatggtcttcattgccacagtgacaggctccctgagcctggtgactgtcgtgggcaacatcctggtgatgctgtccatcaaggtcaacaggcagctgcagacagtcaacaactacttcctcttcagcctggcgtgtgctgatctcatcataggcgccttctccatgaacctctacaccgtgtacatcatcaagggctactggcccctgggcgccgtggtctgcgacctgtggctggccctggactacgtggtgagcaacgcctccgtcatgaaccttctcatcatcagctttgaccgctacttctgcgtcaccaagcctctcacctaccctgcccggcgcaccaccaagatggcaggcctcatgattgctgctgcctgggtactgtccttcgtgctctgggcgcctgccatcttgttctggcagtttgtggtgggtaagcggacggtgcccgacaaccagtgcttcatccagttcctgtccaacccagcagtgacctttggcacagccattgctgccttctacctgcctgtggtcatcatgacggtgctgtacatccacatctccctggccagtcgcagccgagtccacaagcaccggcccgagggcccgaaggagaagaaagccaagacgctggccttcctcaagagcccactaatgaagcagagcgtcaagaagcccccgcccggggaggccgcccgggaggagctgcgcaatggcaagctggaggaggcccccccgccagcgctgccaccgccaccgcgccccgtggctgataaggacacttccaatgagtccagctcaggcagtgccacccagaacaccaaggaacgcccagccacagagctgtccaccacagaggccaccacgcccgccatgcccgcccctcccctgcagccgcgggccctcaacccagcctccagatggtccaagatccagattgtgacgaagcagacaggcaatgagtgtgtgacagccattgagattgtgcctgccacgccggctggcatgcgccctgcggccaacgtggcccgcaagttcgccagcatcgctcgcaaccaggtgcgcaagaagcggcagatggcggcccgggagcgcaaagtgacacgaacgatctttgccattctgctagccttcatcctcacctggacgccctacaacgtcatggtcctggtgaacaccttctgccagagctgcatccctgacacggtgtggtccattggctactggctctgctacgtcaacagcaccatcaaccctgcctgctatgctctgtgcaacgccacctttaaaaagaccttccggcacctgctgctgtgccagtatcggaacatcggcactgccaggtaggcaggcaggagtgccctaggaggtgctg

SEQ ID NO: 5768 - DNA, 3043 bp, Homo sapiens
atcagatcaactgctgttaccagataaaggcaaaactcacccttctggttctataatcctatccaaatggagtcttcatctaccgcatactatcctaactaatgctacaggattatcaggaatacagatataaagacactgcaagaaataaaacactggcaaaataaaacatgaaaggaaagtagagaaggcattttgggtctcgaagcttactatttccagccagagttcaaattactgagcttcaaacaaaccactgccaggaacctaggaaatcattctcagccttgcaacttaaaatatggtacatggatcagtagcatcaagaatactcaggagcttttcagaaatgtgcaattgtgaaatatggccaagatggcggattagaagcagcggcagcccgcagctctcatgcaaaggaatgaaaggtgtgagtgaatacagcgccttcaactgaaatatccaggttctcgctttgggactaattgggcaaacaacttgacccacagaaaacaaagaaaagcagggtggggtgacggcccacctgggagcagcacagagccaaaggaacccccacctccagccaagggaagcgatgctggccaagaagagctgaaatagaaaacagcctagaacctaacactatttactgtaaaatttttgcaccaggatggaaggggattcttaccacaatgcaaccaccgtcaatggcaccccagtaaatcaccagcctttggaacgccacaggttgtgggaagtcatcaccattgcagctgtgactgctgtggtaagcctgatcaccattgtgggcaatgtcttggtcatgatctccttcaaagtcaacagccagctcaagacagttaacaactattacctgctcagcttagcctgtgcagatctcatcattggaatcttctccatgaacctctacaccacctacatcctcatgggacgctgggctctcgggagtctggcttgtgacctttggcttgcactggactacgtggccagcaacgcttctgtcatgaaccttctggtgatcagttttgaccgttacttttccatcacaagacccttgacatatcgggccaagcgtactccgaaaagggctggcatcatgattggcttggcctggctgatctccttcatcctctgggccccagcaatcctctgctggcagtacttggttgggaagcggacagttccactggatgagtgccagatccagtttctctctgagcccaccatcacttttggcactgccattgctgccttctacatccctgtttctgtcatgaccatcctctactgtcgaatctaccgggaaacagagaagcgaaccaaggacctggctgacctccagggttctgactctgtgaccaaagctgagaagagaaagccagctcatagggctctgttcagatcctgcttgcgctgtcctcgacccaccctggcccagcgggaaaggaaccaggcctcctggtcatcctcccgcaggagcacctccaccactgggaagccatcccaagccactggcccaagcgccaattgggccaaagctgagcagctcaccacctgtagcagctacccttcctcagaggatgaggacaagcccgccactgaccctgtcctccaagtggtctacaagagtcagggtaaggaaagcccaggggaagaattcagtgctgaagagactgaggaaacttttgtgaaagctgaaactgaaaaaagtgactatgacaccccaaactaccttctgtctccagcagctgctcatagacccaagagtcagaaatgtgtggcctataagttccgattggtggtaaaagctgacgggaaccaggagaccaacaatggctgtcacaaggtgaaaatcatgccctgccccttcccagtggccaaggaaccttcaacgaaaggcctcaatcccaaccccagccatcaaatgaccaaacgaaagagagtggtcctagtcaaagagaggaaagcagcccagacactgagtgccattctcctggccttcatcatcacatggaccccgtataacatcatggtcctggtttctaccttctgtgacaagtgtgtcccagtcaccctgtggcacttgggctattggttgtgctatgtcaatagcactgtcaaccccatctgctatgccctctgcaacagaaccttcaggaagacctttaagatgctgcttctctgccgatggaaaaagaaaaaagtggaagagaagttgtactggcaggggaacagcaagctaccctgaaaagtcaacaactcctctcgaaagaacaatgaccacagtcaacatcctctgaggatgagcaagctgattctggtttgtatattttcaaaaagaagacatctcattttgagtccttgaagatttttgtaaaggctcaagtttggttgccaaatggaaggggccatagctgcagcaattgctgacatattaaatgactcttgcctatgaccaaggccatttgatgccaggggagtttgccaatgaagtaaagggataggctcatggcccttcacaagaggaagcacactgggtaacaatgaacagtgactcagggaacttatgccccttctgtaggaaacagcagagaccaggtggaaaccttttcctgtggaaacctgtcatagaattttgtgcaatatgtatgtgtctatgaagctgtcttgtgccagtgagaaccagcaggagaatgtacaacagtgtcacttgttaacgagactgatattcaacaggcttctaagaatatgtatcttcataaactgatcactatctattatgcagctattatgtggtctatactatactgtggtttgttttcctgtccccacatctgagtgaaggtcttgctcttccctttcatatccaatgtcaattccttgtactcactgaacccatgctgatctccagggaaccatccttcctctcagaatccagagtctggaaggactgaaacctggtcatacccagtcctttcaaggggcctcttttctactaataaagatggatcaagtctccaca

SEQ ID NO: 5769 - DNA, 2687 bp, Homo sapiens
agtggtacaagatgtggaggtggaagacagtgatattgtgtccggaatttattccttcttgtgggttctcggtctcactaacttcaagaatgaagccgcagaccgtcgcggtgtgttacagttcttaaagatggtgtgtccagagtttgttccttcagatgttcagatgtgtcgagtttcttccttccggtgggttcgtggtctccctgacttcagaagtgaagccacataccttcgcaatgctggccaagaagagctgaaatagaaaacagcctagaacctaacactatttactgtaaaatttttgcaccaggatggaaggggattcttaccacaatgcaaccaccgtcaatggcaccccagtaaatcaccagcctttggaacgccacaggttgtgggaagtcatcaccattgcagctgtgactgctgtggtaagcctgatcaccattgtgggcaatgtcttggtcatgatctccttcaaagtcaacagccagctcaagacagttaacaactattacctgctcagcttagcctgtgcagatctcatcattggaatcttctccatgaacctctacaccacctacatcctcatgggacgctgggctctcgggagtctggcttgtgacctttggcttgcactggactacgtggccagcaacgcttctgtcatgaaccttctggtgatcagttttgaccgttacttttccatcacaagacccttgacatatcgggccaagcgtactccgaaaagggctggcatcatgattggcttggcctggctgatctccttcatcctctgggccccagcaatcctctgctggcagtacttggttgggaagcggacagttccactggatgagtgccagatccagtttctctctgagcccaccatcacttttggcactgccattgctgccttctacatccctgtttctgtcatgaccatcctctactgtcgaatctaccgggaaacagagaagcgaaccaaggacctggctgacctccagggttctgactctgtgaccaaagctgagaagagaaagccagctcatagggctctgttcagatcctgcttgcgctgtcctcgacccaccctggcccagcgggaaaggaaccaggcctcctggtcatcctcccgcaggagcacctccaccactgggaagccatcccaagccactggcccaagcgccaattgggccaaagctgagcagctcaccacctgtagcagctacccttcctcagaggatgaggacaagcccgccactgaccctgtcctccaagtggtctacaagagtcagggtaaggaaagcccaggggaagaattcagtgctgaagagactgaggaaacttttgtgaaagctgaaactgaaaaaagtgactatgacaccccaaactaccttctgtctccagcagctgctcatagacccaagagtcagaaatgtgtggcctataagttccgattggtggtaaaagctgacgggaaccaggagaccaacaatggctgtcacaaggtgaaaatcatgccctgccccttcccagtggccaaggaaccttcaacgaaaggcctcaatcccaaccccagccatcaaatgaccaaacgaaagagagtggtcctagtcaaagagaggaaagcagcccagacactgagtgccattctcctggccttcatcatcacatggaccccgtataacatcatggtcctggtttctaccttctgtgacaagtgtgtcccagtcaccctgtggcacttgggctattggttgtgctatgtcaatagcactgtcaaccccatctgctatgccctctgcaacagaaccttcaggaagacctttaagatgctgcttctctgccgatggaaaaagaaaaaagtggaagagaagttgtactggcaggggaacagcaagctaccctgaaaagtcaacaactcctctcgaaagaacaatgaccacagtcaacatcctctgaggatgagcaagctgattctggtttgtatattttcaaaaagaagacatctcattttgagtccttgaagatttttgtaaaggctcaagtttggttgccaaatggaaggggccatagctgcagcaattgctgacatattaaatgactcttgcctatgaccaaggccatttgatgccaggggagtttgccaatgaagtaaagggataggctcatggcccttcacaagaggaagcacactgggtaacaatgaacagtgactcagggaacttatgccccttctgtaggaaacagcagagaccaggtggaaaccttttcctgtggaaacctgtcatagaattttgtgcaatatgtatgtgtctatgaagctgtcttgtgccagtgagaaccagcaggagaatgtacaacagtgtcacttgttaacgagactgatattcaacaggcttctaagaatatgtatcttcataaactgatcactatctattatgcagctattatgtggtctatactatactgtggtttgttttcctgtccccacatctgagtgaaggtcttgctcttccctttcatatccaatgtcaattccttgtactcactgaacccatgctgatctccagggaaccatccttcctctcagaatccagagtctggaaggactgaaacctggtcatacccagtcctttcaaggggcctcttttctactaataaagatggatcaagtctccaca

SEQ ID NO: 5770 - DNA, 572 bp, Homo sapiens
cagataatgttttttaaagcagcttgatttggaagcgtgtgtaattctgaaatacgaacaagcagaacttttccagggggtcaaatgcatataggaacaaccaggatttctcattgctgaagcattcaatgaatctttaataagttctcaacactcagattgtttgtgatcagatcaactgctgttaccagataaaggcaaaactcacccttctggttctataatcctatccaaatggagtcttcatctaccgcatactatcctaactaatgctacaggattatcaggaatacagatataaagacactgcaagaaataaaacactggcaaaataaaacatgaaaggaaagtagagaaggcattttgggtctcgaagcttactatttccagccagagttcaaattactgagcttcaaacaaaccactgccagatgctggccaagaagagctgaaatagaaaacagcctagaacctaacactatttactgtaaaatttttgcaccaggatggaaggggattcttaccacaatgcaaccaccgtcaatggcaccccagtaaatcaccagcctttg

SEQ ID NO: 5771 - DNA, 1980 bp, Homo sapiens
cagccagagtgccagtgagaagcacaggccaccactctgccctggtccacacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagggtgacatggtagatctgccacgccccagctgcgtgactttgggagttcctttgttttctcatctgcagaatgagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagtgttttcatattgcttctccctttagttctgctgtctccctgaagagtgaaccctctttagtaaatgaaactaatcactaaaaaaagtgttcatttccagtgtctggaagagtttttgccaggataaccgaggttttctgttgcattgtcattgctgttatatttatatatttacttattttgtctaaccacgagaccactagggagttgctgatgttctaaatgaagtgtattctttgcttaagagtcagttttgtacctactaagaaaaccccatctaccagtcctaaagagataa

SEQ ID NO: 5772 - DNA, 1984 bp, Homo sapiens
agacaagcacccagccagagtgccagtgagaagcacaggccaccactctgccctggtccacacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagtgttttcatattgcttctccctttagttctgctgtctccctgaagagtgaaccctctttagtaaatgaaactaatcactaaaaaaagtgttcatttccagtgtctggaagagtttttgccaggataaccgaggttttctgttgcattgtcattgctgttatatttatatatttacttattttgtctaaccacgagaccactagggagttgctgatgttctaaatgaagtgtattctttgcttaagagtcagttttgtacctactaagaaaaccccatctaccagtcctaaagagataaggcatttgatttggagagagaggaagcagtagaaatgaaataaactaaaatgcaaactgcatcaaaaa

SEQ ID NO: 5773 - DNA, 1945 bp, Homo sapiens
taattttgccctaggtctggccaggaggcctcacatccagagacctgcccccgctcttgcagtgccagggccatggggctccggagccaccacctcagcctgggccttctgcttctgtttctactccctgcagagtgcctgggagctgagggccggctggctctcaagctgttccgtgacctctttgccaactacacaagtgccctgagacctgtggcagacacagaccagactctgaatgtgaccctggaggtgacactgtcccagatcatcgacatggatgaacggaaccaggtgctgaccctgtatctgtggatacggcaggagtggacagatgcctacctacgatgggaccccaatgcctatggtggcctggatgccatccgcatccccagcagtcttgtgtggcggccagacatcgtactctataacaaagccgacgcgcagcctccaggttccgccagcaccaacgtggtcctgcgccacgatggcgccgtgcgctgggacgcgccggccatcacgcgcagctcgtgccgcgtggatgtagcagccttcccgttcgacgcccagcactgcggcctgacgttcggctcctggactcacggcgggcaccaactggatgtgcggccgcgcggcgctgcagccagcctggcggacttcgtggagaacgtggagtggcgcgtgctgggcatgccggcgcggcggcgcgtgctcacctacggctgctgctccgagccctaccccgacgtcaccttcacgctgctgctgcgccgccgcgccgccgcctacgtgtgcaacctgctgctgccctgcgtgctcatctcgctgcttgcgccgctcgccttccacctgcctgccgactcaggcgagaaggtgtcgctgggcgtcaccgtgctgctggcgctcaccgtcttccagttgctgctggccgagagcatgccaccggccgagagcgtgccgctcatcgggaagtactacatggccactatgaccatggtcacattctcaacagcactcaccatccttatcatgaacctgcattactgtggtcccagtgtccgcccagtgccagcctgggctagggccctcctgctgggacacctggcacggggcctgtgcgtgcgggaaagaggggagccctgtgggcagtccaggccacctgagttatctcctagcccccagtcgcctgaaggaggggctggccccccagcgggcccttgccacgagccacgatgtctgtgccgccaggaagccctactgcaccacgtagccaccattgccaataccttccgcagccaccgagctgcccagcgctgccatgaggactggaagcgcctggcccgtgtgatggaccgcttcttcctggccatcttcttctccatggccctggtcatgagcctcctggtgctggtgcaggccctgtgagggctgggactaagtcacagggatctgctgcagccacagctcctccagaaagggacagccacggccaagtggttgctggtctttgggccagccagtctctccccactgctcctaagatcctgagacacttgacttcacaatccacaagggagcactcattgtctacacaccctaactaaaggaagtccagagcctgccactcccctaattccaaaaaaaagaggaactctacaaaggccaagatcacagagtacagtcttggagggacagaattgtttgtgctgggtattggagctctcagtggggagcacatgggttataatgagaaactgaactgtactgctgcatttcctgtcttccttcctaggtggctgctttgcagggctttggctgttacctttccctgctgaggggctcagggaaaagggtcggggattctcagtcgagtttccagagcaggaggccctacagacatttggccccaaatccctgactcaataaagtaagcgtgtacctagca

SEQ ID NO: 5774 - DNA, 4066 bp, Homo sapiens
agagaggctgtgtgtgtgtgtgtgtgtgtgtatgtgtgtgtgtgtgtgagagagagagagaacagcgtgagcctgtgtgcttgtgtgctgagccctcatcccctcctggggccaggcttgggtttcacctgcagaatcgcttgtgctgggctgcctgggctgtcctcagtggcacctgcatgaagccgttctggctgccagagctggacagccccaggaaaacccacctctctgcagagcttgcccagctgtccccgggaagccaaatgcctctcatgtaagtcttctgctcgacggggtgtctcctaaaccctcactcttcagcctctgtttgaccatgaaatgaagtgactgagctctattctgtacctgccactctatttctggggtgacttttgtcagctgcccagaatctccaagccaggctggttctctgcatcctttcaatgacctgttttcttctgtaaccacaggttcggtggtgagaggaagcctcgcagaatccagcagaatcctcacagaatccagcagcagctctgctggggacatggtccatggtgcaacccacagcaaagccctgacctgacctcctgatgctcaggagaagccatgggcccctcctgtcctgtgttcctgtccttcacaaagctcagcctgtggtggctccttctgaccccagcaggtggagaggaagctaagcgcccacctcccagggctcctggagacccactctcctctcccagtcccacggcattgccgcagggaggctcgcataccgagactgaggaccggctcttcaaacacctcttccggggctacaaccgctgggcgcgcccggtgcccaacacttcagacgtggtgattgtgcgctttggactgtccatcgctcagctcatcgatgtggatgagaagaaccaaatgatgaccaccaacgtctggctaaaacaggagtggagcgactacaaactgcgctggaaccccactgattttggcaacatcacatctctcagggtcccttctgagatgatctggatccccgacattgttctctacaacaatgcagatggggagtttgcagtgacccacatgaccaaggcccacctcttctccacgggcactgtgcactgggtgcccccggccatctacaagagctcctgcagcatcgacgtcaccttcttccccttcgaccagcagaactgcaagatgaagtttggctcctggacttatgacaaggccaagatcgacctggagcagatggagcagactgtggacctgaaggactactgggagagcggcgagtgggccatcgtcaatgccacgggcacctacaacagcaagaagtacgactgctgcgccgagatctaccccgacgtcacctacgccttcgtcatccggcggctgccgctcttctacaccatcaacctcatcatcccctgcctgctcatctcctgcctcactgtgctggtcttctacctgccctccgactgcggcgagaagatcacgctgtgcatttcggtgctgctgtcactcaccgtcttcctgctgctcatcactgagatcatcccgtccacctcgctggtcatcccgctcatcggcgagtacctgctgttcaccatgatcttcgtcaccctgtccatcgtcatcaccgtcttcgtgctcaatgtgcaccaccgctcccccagcacccacaccatgccccactgggtgcggggggcccttctgggctgtgtgccccggtggcttctgatgaaccggcccccaccacccgtggagctctgccaccccctacgcctgaagctcagcccctcttatcactggctggagagcaacgtggatgccgaggagagggaggtggtggtggaggaggaggacagatgggcatgtgcaggtcatgtggccccctctgtgggcaccctctgcagccacggccacctgcactctggggcctcaggtcccaaggctgaggctctgctgcaggagggtgagctgctgctatcaccccacatgcagaaggcactggaaggtgtgcactacattgccgaccacctgcggtctgaggatgctgactcttcggtgaaggaggactggaagtatgttgccatggtcatcgacaggatcttcctctggctgtttatcatcgtctgcttcctggggaccatcggcctctttctgcctccgttcctagctggaatgatctgactgcacctccctcgagctggctcccagggcacccccgctgaccatcttttgaccgtctctgctacagctgcctctggtgtcccctttgggatgagcaggtgcctctccgcggagtctggacactgacccagggattgcaggcttccatccagcttaacgttattgtaccagggctgacagcctgctgggtgcaaagccctgttttggatacggaggagctggggaagctctgcagaaggtcgcaatagtgtggtgaccaagtggggcagagtaagattctcctggaggagcagtgcagaccctaagtgacagaagggtcaaccagggggacagtggggccagggtgacgaggaagggaatgcagacctcaaaggaggggccgtgggggcaaaggggagggttcttggatgtggaagggctttgaacaatgtttagatttggagatgagcccaaagtgccagggagaacagccaggtgaggtgggaggttggagagccaggtgaggtctctgtaagtcaggctggggttgaagtttggagtctgtccgagtttgcagggtgctgagctgtatggtccagcaggggagtaataagggctcttctggaaggggaggaagcgggaggcagggcctgcacctgatgtggaggtacagggcagatcttccctaccggggagggatggatggttggatacaggtggctgggctattccatccatctggaagcacatttgagcctccaggcttctccttgacgtcattcctctccttccttgctgcaaaatggctctgcaccagccggcccccaggaggtctggcagagctgagagccatggcctgcaggggctccatatgtccctacgcgtgcagcaggcaaacaagaaagaccatcctgagctgctcctgacccacctcaaactcatctcatttggcctgtcctccctcccttcacccctccttccctccccaggaaccctgttccctgtgcctggctccatcaggaggaggcctcacttgggagttgaagatctttgcctttagttcctttgattctgaacttctcaaaggcaggtactctgcctgttatttttcccacccccagcacctagcacagcgccgggtgagtggggtcagcacttagggcgtttgttctgagtggttgaggggagcaagctggattgtttgggccccaggactgttgtgtagatggcaaagctgtggtcccgtcccttatcagcctgcctcgtctctcccagagccccgaggtgtgttgacctgctctgaacccttcagagcagcctgtgtgtgcaccttggaatgcaatgcaccaccccacagtctgaggctgcacccaggatcccaggccgagctgctgctcctgggatcgggcaacagacctccccccaactctgtccagactggagggtgggacattggcagctaacagatgtgggcatcgggttctcgggacagcatggaggctccaggcaggaagccgagcagggcgagcttccagtttccttttggtcctaggggtcccctccttccaaaccccaaaatgtctctccctgacactctcaggggaaaccagcctggctgtgacgccctggcccaggccctgccatgcctcacttctctcccacaacccccctgctcatggcacatctggtctctggctcctgtctactcgtgtgcatgcagcccccagcgccccctctcctcccacttgctctccggaggcctcagagctctcgggtccaggctcccagacccactctcctgagacagtgatgttcacttctgttatccatgtctcccatccatcttgcatgtgaataaagagattaaataaagctgcacctactgctg

SEQ ID NO: 5775 - DNA, 2245 bp, Homo sapiens
tttcttgggcttgctcaggttcggtggtgagaggaagcctcgcagaatccagcagaatcctcacagaatccagcagcagctctgctggggacatggtccatggtgcaacccacagcaaagccctgacctgacctcctgatgctcaggagaagccatgggcccctcctgtcctgtgttcctgtccttcacaaagctcagcctgtggtggctccttctgaccccagcaggtggagaggaagctaagcgcccacctcccagggctcctggagacccactctcctctcccagtcccacggcattgccgcagggaggctcgcataccgagactgaggaccggctcttcaaacacctcttccggggctacaaccgctgggcgcgcccggtgcccaacacttcagacgtggtgattgtgcgctttggactgtccatcgctcagctcatcgatgtggatgagaagaaccaaatgatgaccaccaacgtctggctaaaacaggagtggagcgactacaaactgcgctggaaccccactgattttggcaacatcacatctctcagggtcccttctgagatgatctggatccccgacattgttctctacaacaatgcagatggggagtttgcagtgacccacatgaccaaggcccacctcttctccacgggcactgtgcactgggtgcccccggccatctacaagagctcctgcagcatcgacgtcaccttcttccccttcgaccagcagaactgcaagatgaagtttggctcctggacttatgacaaggccaagatcgacctggagcagatggagcagactgtggacctgaaggactactgggagagcggcgagtgggccatcgtcaatgccacgggcacctacaacagcaagaagtacgactgctgcgccgagatctaccccgacgtcacctacgccttcgtcatccggcggctgccgctcttctacaccatcaacctcatcatcccctgcctgctcatctcctgcctcactgtgctggtcttctacctgccctccgactgcggcgagaagatcacgctgtgcatttcggtgctgctgtcactcaccgtcttcctgctgctcatcactgagatcatcccgtccacctcgctggtcatcccgctcatcggcgagtacctgctgttcaccatgatcttcgtcaccctgtccatcgtcatcaccgtcttcgtgctcaatgtgcaccaccgctcccccagcacccacaccatgccccactgggtgcggggggcccttctgggctgtgtgccccggtggcttctgatgaaccggcccccaccacccgtggagctctgccaccccctacgcctgaagctcagcccctcttatcactggctggagagcaacgtggatgccgaggagagggaggtggtggtggaggaggaggacagatgggcatgtgcaggtcatgtggccccctctgtgggcaccctctgcagccacggccacctgcactctggggcctcaggtcccaaggctgaggctctgctgcaggagggtgagctgctgctatcaccccacatgcagaaggcactggaaggtgtgcactacattgccgaccacctgcggtctgaggatgctgactcttcggtgaaggaggactggaagtatgttgccatggtcatcgacaggatcttcctctggctgtttatcatcgtctgcttcctggggaccatcggcctctttctgcctccgttcctagctggaatgatctgactgcacctccctcgagctggctcccagggcacccccgctgaccatcttttgaccgtctctgctacagctgcctctggtgtcccctttgggatgagcaggtgcctctccgcggagtctggacactgacccagggattgcaggcttccatccagcttaacgttattgtaccagggctgacagcctgctgggtgcaaagccctgttttggatacggaggagctggggaagctctgcagaaggtcgcaatagtgtggtgaccaagtggggcagagtaagattctcctggaggagcagtgcagaccctaagtgacagaagggtcaaccagggggacagtggggccagggtgacgaggaagggaatgcagacctcaaaggaggggccgtgggggcaaaggggagggttcttggatgtggaagggctttgaacaatgtttagatttggagatgagcccaaagtgccagggagaacagccaggtgaggtgggaggttggagagccaggt

SEQ ID NO: 5776 - DNA, 3202 bp, Homo sapiens
ccttcctggtggtggtgacagcacctgctcagatctggtcggacgccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagtaagaacgtactttctgttatcaagctaccagctttgtttttggcatttcgaggtttacttattttccacttatcttggaatcatgcaaaaaaaaaaatgtcaagagtatttattaccgataaatgaacatttaactagcctttttggtatggtaaagagatgtcaaaatgtgattctatgtgattagtatgctatgctatggaatatacatgtaaaaatgtttccttttagttgttgaaacaaaactggatagaaaaatgctgttcagaaatatgaaaagtcattcagttatcactacagatctcccagtaatttttcttatttagcccataatctctttgaaggtttatactaattcagcaatcccccatcgttacccatttcttaccatgcatttctcgttctttactgggtctaaagggctatgcctccatttcagagagcttcaactacttctcttgcatacttctaaattataccatgagaaatcatgcctagttattcattgttaatataactgtcttagtacaccataaactgggtggattataaacaacagaaacttctcagttttggaggttgggaggtccaaggtcaaggcaccagcaaatttggtgtctggtgagggtcctcttcctcaaagggtgccttctagctgtgtcctcacatgactgaagggactagctatctctgtggggtctattttataagggcactaaccccattcatgagagcagagcccccatggcctaatcacctttccaaggccccaccttctatctaagacaatcacgctgggaataggtttcaacatatgaattgggggaggacacatttggaccacagcatgaacctttagaacagggtttctcagccttagcactatggacattttgggctggataaatatgtgttggtacagaatgggggtatcctgtgcattgtaggatctttagcagtaccctagcctcaactcactagatgccaatgacataccttgcttcttcaccagttatgataaccaagaatgtctccattgttaaatgttcccttaggagcaaaattgcccctggttgagaaacattgctttagacaaattgttaagagtatcatgtactacacttctgaaacttaacgtgatcatcaccactgacagatgattcacagagactgtttgaatcttgtctcactagtttttcctgtgcaaaaataaaatggacagaattgcagccc

SEQ ID NO: 5777 - DNA, 2238 bp, Homo sapiens
accaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccagtccaaaggctgcaaggagggaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagtaagaacgtactttctgttatcaagctaccagctttgtttttggcatttcgaggtttacttattttccacttatcttggaatcatgcaaaaaaaaaaatgtcaagagtatttattaccgataaatgaacatttaactagcctttttggtatggtaaagagatgtcaaaatgtgattctatgtgattagtatgctatgctatggaatatacatgtaaaaatgtttccttttagttgttgaaacaaaactggatagaaaaatgctgttcagaaatatgaaaagtcattcagttatcactacagatctcccagtaatttttcttatttagcccataatctctttgaaggtttatactaattcagcaatcccccatcgttacccatttcttaccatgcatttctcgttctttactgggtctaaagggctatgcctccatttcagagagcttcaactacttctcttgcatacttctaaattataccatgagaaatcatgcctagttattcattgttaatataactgtcttagtacaccataaactgggtggattataaacaacagaaacttctcagttttggaggttgggaggtccaaggtcaaggcaccagcaaatttggtgtctggtgagggtcctcttcctcaaagggtgccttctagctgtgtcctcacatgactgaagggactagctatctctgtggggtctattttataagggcactaaccccattcatgagagcagagcccccatggcctaatcacctttccaaggccccaccttctatctaagacaatcacgctgggaataggtttcaacatatgaattgggggaggacacatttggaccacagcatgaacctttagaacagggtttctcagccttagcactatggacattttgggctggataaatatgtgttggtacagaatgggggtatcctgtgcattgtaggatctttagcagtaccctagcctcaactcactagatgccaatgacataccttgcttcttcaccagttatgataaccaagaatgtctccattgttaaatgttcccttaggagcaaaattgcccctggttgagaaacattgctttagacaaattgttaagagtatcatgtactacacttctgaaacttaacgtgatcatcaccactgacagatgattcacagagactgtttgaatcttgtctcactagtttttcctgtgcaaaaataaaatggacagaattgcagccc

SEQ ID NO: 5778 - DNA, 2030 bp, Homo sapiens
gtccttcccagggtgtgttagcgtctctcctacggcgcccgcctagcccggtggtcccaaccccctgcgggagctgcacacgccccggaaacctgggacagaaactgagtccctctccttcctggtggtggtgacagcacctgctcagatctggtcggacgccgccggccggagcacccagcccggcggagaaggagctcgcccggcgctggggactgggacctggagccccttcccctaccgcacgtacgccccgccccgcgcacgcccgcccgcccgcccgcgcctggcgcagcttcactccggatggttcctgtcctcccgcgggtccgagggcgctggaaacccagcggcggcgaagcggagaggagccccgcgcgtctccgcccgcacggctccaggtctggggtctgcgctggagccgcgcggggagaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagaggaacaaaaagcccaagagatccaacaattgaaacgaaaagaaaagtccacagaaacatccgatcaagaacctgggctatgaatttccaatcttcaacaacctgttaggaaaaaaataaaaatgcattaaataattgtaaa

SEQ ID NO: 5779 - DNA, 1889 bp, Homo sapiens
gaggccgtctctgcgaccgccgcgcccgctcccgaccgtccgggtccgcggccagcccggccaccagccatgggctctggcccgctctcgctgcccctggcgctgtcgccgccgcggctgctgctgctgctgctgctgtctctgctgccagtggccagggcctcagaggctgagcaccgtctatttgagcggctgtttgaagattacaatgagatcatccggcctgtagccaacgtgtctgacccagtcatcatccatttcgaggtgtccatgtctcagctggtgaaggtggatgaagtaaaccagatcatggagaccaacctgtggctcaagcaaatctggaatgactacaagctgaaatggaacccctctgactatggtggggcagagttcatgcgtgtccctgcacagaagatctggaagccagacattgtgctgtataacaatgctgttggggatttccaggtggacgacaagaccaaagccttactcaagtacactggggaggtgacttggatacctccggccatctttaagagctcctgtaaaatcgacgtgacctacttcccgtttgattaccaaaactgtaccatgaagttcggttcctggtcctacgataaggcgaaaatcgatctggtcctgatcggctcttccatgaacctcaaggactattgggagagcggcgagtgggccatcatcaaagccccaggctacaaacacgacatcaagtacaactgctgcgaggagatctaccccgacatcacatactcgctgtacatccggcgcctgcccttgttctacaccatcaacctcatcatcccctgcctgctcatctccttcctcactgtgctcgtcttctacctgccctccgactgcggtgagaaggtgaccctgtgcatttctgtcctcctctccctgacggtgtttctcctggtgatcactgagaccatcccttccacctcgctggtcatccccctgattggagagtacctcctgttcaccatgatttttgtaaccttgtccatcgtcatcaccgtcttcgtgctcaacgtgcactacagaaccccgacgacacacacaatgccctcatgggtgaagactgtattcttgaacctgctccccagggtcatgttcatgaccaggccaacaagcaacgagggcaacgctcagaagccgaggcccctctacggtgccgagctctcaaatctgaattgcttcagccgcgcagagtccaaaggctgcaaggagggctacccctgccaggacgggatgtgtggttactgccaccaccgcaggataaaaatctccaatttcagtgctaacctcacgagaagctctagttctgaatctgttgatgctgtgctgtccctctctgctttgtcaccagaaatcaaagaagccatccaaagtgtcaagtatattgctgaaaatatgaaagcacaaaatgaagccaaagagattcaagatgattggaagtatgttgccatggtgattgatcgtatttttctgtgggttttcaccctggtgtgcattctagggacagcaggattgtttctgcaacccctgatggccagggaagatgcataagcactaagctgtgtgcctgcctgggagacttccttgtgtcagggcaggaggaggctgcttcctagctggagtgcaatggcgtgatctcagctcaccgcaacctccgccacctgggttcaagcgattctcctgccgcagcctcccaggtagctgggattacaggaacaaaaagcccaagagatccaacaattgaaacgaaaagaaaagtccacagaaacatccgatcaagaacctgggctatgaatttccaatcttcaacaacctgttaggaaaaaaataaaaatgcattaaataattgtaaa

SEQ ID NO: 5780 - DNA, 5027 bp, Homo sapiens
gcaccagaacccggggaggcgccgaggctggaccgagcccaccctggctgtgcctgtgccgagctgagcctgctgtggctgtgttgctgcacatttaccagtgctgacggggacttcgcggtcacccacctgaccaaggcccacctgttccatgacgggcgggtgcagtggactcccccggccatttacaagagctcctgcagcatcgacgtcaccttcttccccttcgaccagcagaactgcaccatgaaattcggctcctggacctacgacaaggccaagatcgacctggtgaacatgcacagccgcgtggaccagctggacttctgggagagtggcgagtgggtcatcgtggatgccgtgggcacctacaacaccaggaagtacgagtgctgtgccgagatctacccggacatcacctatgccttcgtcatccggcggctgccgctcttctacaccatcaacctcatcatcccctgcctgctcatctcctgcctcaccgtgctggtcttctacctgccctccgagtgtggcgagaagatcacgctgtgcatctccgtgctgctgtcgctcaccgtcttcctgctgctcatcaccgagatcatcccgtccacctcactggtcatcccactcatcggcgagtacctgctgttcaccatgatcttcgtcaccctgtccatcgtcatcacggtcttcgtgctcaacgtgcaccaccgctcgccacgcacgcacaccatgcccacctgggtacgcagggtcttcctggacatcgtgccacgcctgctcctcatgaagcggccgtccgtggtcaaggacaattgccggcggctcatcgagtccatgcataagatggccagtgccccgcgcttctggcccgagccagaaggggagccccctgccacgagcggcacccagagcctgcacccgccctcaccgtccttctgtgtccccctggatgtgccggctgagcctgggccttcctgcaagtcaccctccgaccagctccctcctcagcagcccctggaagctgagaaagccagcccccacccctcgcctggaccctgccgcccgccccacggcacccaggcaccagggctggccaaagccaggtccctcagcgtccagcacatgtccagccctggcgaagcggtggaaggcggcgtccggtgccggtctcggagcatccagtactgtgttccccgagacgatgccgcccccgaggcagatggccaggctgccggcgccctggcctctcgcaacacccactcggctgagctcccacccccagaccagccctctccgtgcaaatgcacatgcaagaaggagccctcttcggtgtccccgagcgccacggtcaagacccgcagcaccaaagcgccgcccccgcacctgcccctgtcgccggccctgacccgggcggtggagggcgtccagtacattgcagaccacctgaaggccgaagacacagacttctcggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctgtaagacggccttggacggggacacggcctctggggagaccgagtgtggagctgcttccagttggactgtggcctcaggaggcagtggcttggagcagaggtgggggtcggcgccttctacctgcaggactcgggctaagtccagttcaagagtctcctgagctcccctgcagatggaactcactcctcccagtctctcagcagatctggtgatggtcccgaccgccccaaggggcccttgaagggagttcacgccccttcagccccaagcgccccgtcttctggaggcccggccgcctctcccacccaccgtgtcctgcgcctgtgtgggcttcaacttctcccccagggtccttgagcctctcgggccccatgagggtgagccagcagcgctccaatctgcttcgctaggagagggtccaggcagggattgtgtttggttgtgttttgggtaagttagtgagaactcaagtcttgtgcctaaggagccttggagaacagagttttgtggagctggttccgcgtggggagaatcgggaggcccacgcgggaccagctctcccctgcgcaggccctccgcgggggacaggaacacccagccccagcgagtctggagaccaggactctgccttccaggcgtagggccagggctctggcaggtggccagggctccacgggggcctagtggcttcagcccctggggtacttctgtgttgtgattccccggagctgggaaggtcccgaatggagtccagacctgggccctggttcccccaggaccctgagggtttccaccttggcgcgcagcccgggagatccgccctgggctctgggttcgggaagaaggacttcctgctacagtagctgtggggagctggtgggggcatccttgaggacctccacctgggagatgctgggaccctcggggcaggaagtccctgagaagcctcatgggagtcagggagccctggggtttccacacaggcccatgccctccgtcctggcagggcaggcagagctcagcacagcctcacccctgcaggcggtatccagaggtgagggaggcctgaaatgtttccaggcatgaccctggagcccggcagtgcaccccctaaagatggcgcacccggcagccccccagtgtccccaggggcacacttccccttgggatgggcacaggctgccccacccctccatgattccaagggcccagaggggcggggccaggatggcgtgtcccctgcctgtgagtgacatcggttcaggaggagacagtcaggaagcctcctgctgagtggtccacattctgctgcccccagaccccatccagccaggggtggggatggggttgggctctgcgtcccactgagtctcattcctctgtccccgagccgagctctcctgggccagggtctcgtcaggaggtgcctgagagcagaatgaataattgaggttaggaacccggcatgccgagtgccccagaaatgccgctgtgtccccgcgggcagtgacgtgagtggggaggagactcaggcccacattgcccacacctgcctctgaactgctgctggtcacccccacccccgggtgcctgtgaccggggtcctgaggctggggcttttgtgccaggagtgggtgggacacagagacccccgtgccaaatcctgggcatccccagccccctggcccctcccacatcccccgtgtattcaggaccccatctgctgagctctgacctgcccccgctctgccatcagcccctgctgctcctcggccagagctcccaggacgcagggagaccctgggagagtgaggtcatcccggggccatggaagctggcaggagacactggtctcagaggagggatagagacgcagatttcagatgtaagaagcccgatccacattgcataagtggacccagctgccagatgtgtgggcagctgcagggagtggcccggggtgctgggcccagctgtggttgttcttttctgggtcaggagtgactgcggagtggctgggacgctcctgccgggggaccctcctgccgggggtggccgcttgcctgggggaagacccctttccctttctttttttttttgaggctcaaaaaaaaaatccaaataaagcaccatattcccaccacgccaaattaaccttgacaacaatgttggcgtatttgcgtccagtgctgtttttattaattaaggtaaaatttacatatggtgagatgcatgctcttcagtggagacccagcccctagaaggtccctccagcccttcctgtcggcgtccctccccatctgtggctctgacttaagcaccgtggattgacctctccggctcacgaccttcgaggagtcagaatcctgcagttggagcctttgatgtctggcttcttcatcctatgacttagagcttcatccgtgctgttgtgtgtgtccgtagctccttgctgtctgttccttcgtttttaattgtgagcagtgttcttctgtctgaataaactaagacgcagtttgtccatcacctgttagtggactttgcttgcagctgtcggtgattaggaatggaggtgccggtgtgtgcatggcactctatccgttatgcatgtttattttctgcatctgttaatgttttaacatctttcagacccaggactgctcctcctagggccagttagttcccgggggtggacagcttgcctagaacccaccttgccagggctgtgacccccgaccccctatcaaagtctcacactaagccaacgtttccccgccctgtgccaggcaccaggcagcgggagacactgctgcagctcgaagcctgccggggcgccggcccctctgcggctgcttgcgccatcctgccccctccttcccaggggaggccccagtgaaggccctggccagggcttcccagccccttctgcctccggaccggcctgggtgcttcccgtgtggcccggcctggggcgacgtggccctcctctcaggaagcgtggtaatctctcaatggctggcctccggagttgtcactcaggctcccttgtaagttaaggccgggcccaggacactctagggcacgcagctgctgtgggactgctgggttaggtgtcccctggagcagaggcggcttcggatttctaaagtggctgagtcctttcaccttgcaccagaaatgctggatcaggcgcagcacacacagcacctggggatgcaagcccggccagccccatggaccaagccccgccgaccgtgtggcccgccgagcccaggtgcggc

SEQ ID NO: 5781 - DNA, 4776 bp, Homo sapiens
gctgaggcgggcagggccgggcggggccgcgccacggagcccacagcccggcgctccctgccgcgccgccgccgcaccgcgccccacaggagaagacgaaccgggcccggcggccgaagcggcccgcgaggcgcgggaggcatgaagttgggcgcgcacgggcctcgaagcggcggggagccgggagccgcccgcatctagagcccgcgaggtgcgtgcgccatggagctagggggccccggagcgccgcggctgctgccgccgctgctgctgcttctggggaccggcctcctgcgcgccagcagccatgtggagacccgggcccacgccgaggagcggctcctgaagaaactcttctccggttacaacaagtggtcccgacccgtggccaacatctcggacgtggtcctcgtccgcttcggcctgtccatcgctcagctcattgacgtggatgagaagaaccagatgatgaccacgaacgtatgggtgaagcaggagtggcacgactacaagctgcgctgggacccagctgactatgagaatgtcacctccatccgcatcccctccgagctcatctggcggccggacatcgtcctctacaacaatgctgacggggacttcgcggtcacccacctgaccaaggcccacctgttccatgacgggcgggtgcagtggactcccccggccatttacaagagctcctgcagcatcgacgtcaccttcttccccttcgaccagcagaactgcaccatgaaattcggctcctggacctacgacaaggccaagatcgacctggtgaacatgcacagccgcgtggaccagctggacttctgggagagtggcgagtgggtcatcgtggatgccgtgggcacctacaacaccaggaagtacgagtgctgtgccgagatctacccggacatcacctatgccttcgtcatccggcggctgccgctcttctacaccatcaacctcatcatcccctgcctgctcatctcctgcctcaccgtgctggtcttctacctgccctccgagtgtggcgagaagatcacgctgtgcatctccgtgctgctgtcgctcaccgtcttcctgctgctcatcaccgagatcatcccgtccacctcactggtcatcccactcatcggcgagtacctgctgttcaccatgatcttcgtcaccctgtccatcgtcatcacggtcttcgtgctcaacgtgcaccaccgctcgccacgcacgcacaccatgcccacctgggtacgcagggtcttcctggacatcgtgccacgcctgctcctcatgaagcggccgtccgtggtcaaggacaattgccggcggctcatcgagtccatgcataagatggccagtgccccgcgcttctggcccgagccagaaggggagccccctgccacgagcggcacccagagcctgcacccgccctcaccgtccttctgtgtccccctggatgtgccggctgagcctgggccttcctgcaagtcaccctccgaccagctccctcctcagcagcccctggaagctgagaaagccagcccccacccctcgcctggaccctgccgcccgccccacggcacccaggcaccagggctggccaaagccaggtccctcagcgtccagcacatgtccagccctggcgaagcggtggaaggcggcgtccggtgccggtctcggagcatccagtactgtgttccccgagacgatgccgcccccgaggcagatggccaggctgccggcgccctggcctctcgcaacacccactcggctgagctcccacccccagaccagccctctccgtgcaaatgcacatgcaagaaggagccctcttcggtgtccccgagcgccacggtcaagacccgcagcaccaaagcgccgcccccgcacctgcccctgtcgccggccctgacccgggcggtggagggcgtccagtacattgcagaccacctgaaggccgaagacacagacttctcggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctgtaagacggccttggacggggacacggcctctggggagaccgagtgtggagctgcttccagttggactgtggcctcaggaggcagtggcttggagcagaggtgggggtcggcgccttctacctgcaggactcgggctaagtccagttcaagagtctcctgagctcccctgcagatggaactcactcctcccagtctctcagcagatctggtgatggtcccgaccgccccaaggggcccttgaagggagttcacgccccttcagccccaagcgccccgtcttctggaggcccggccgcctctcccacccaccgtgtcctgcgcctgtgtgggcttcaacttctcccccagggtccttgagcctctcgggccccatgagggtgagccagcagcgctccaatctgcttcgctaggagagggtccaggcagggattgtgtttggttgtgttttgggtaagttagtgagaactcaagtcttgtgcctaaggagccttggagaacagagttttgtggagctggttccgcgtggggagaatcgggaggcccacgcgggaccagctctcccctgcgcaggccctccgcgggggacaggaacacccagccccagcgagtctggagaccaggactctgccttccaggcgtagggccagggctctggcaggtggccagggctccacgggggcctagtggcttcagcccctggggtacttctgtgttgtgattccccggagctgggaaggtcccgaatggagtccagacctgggccctggttcccccaggaccctgagggtttccaccttggcgcgcagcccgggagatccgccctgggctctgggttcgggaagaaggacttcctgctacagtagctgtggggagctggtgggggcatccttgaggacctccacctgggagatgctgggaccctcggggcaggaagtccctgagaagcctcatgggagtcagggagccctggggtttccacacaggcccatgccctccgtcctggcagggcaggcagagctcagcacagcctcacccctgcaggcggtatccagaggtgagggaggcctgaaatgtttccaggcatgaccctggagcccggcagtgcaccccctaaagatggcgcacccggcagccccccagtgtccccaggggcacacttccccttgggatgggcacaggctgccccacccctccatgattccaagggcccagaggggcggggccaggatggcgtgtcccctgcctgtgagtgacatcggttcaggaggagacagtcaggaagcctcctgctgagtggtccacattctgctgcccccagaccccatccagccaggggtggggatggggttgggctctgcgtcccactgagtctcattcctctgtccccgagccgagctctcctgggccagggtctcgtcaggaggtgcctgagagcagaatgaataattgaggttaggaacccggcatgccgagtgccccagaaatgccgctgtgtccccgcgggcagtgacgtgagtggggaggagactcaggcccacattgcccacacctgcctctgaactgctgctggtcacccccacccccgggtgcctgtgaccggggtcctgaggctggggcttttgtgccaggagtgggtgggacacagagacccccgtgccaaatcctgggcatccccagccccctggcccctcccacatcccccgtgtattcaggaccccatctgctgagctctgacctgcccccgctctgccatcagcccctgctgctcctcggccagagctcccaggacgcagggagaccctgggagagtgaggtcatcccggggccatggaagctggcaggagacactggtctcagaggagggatagagacgcagatttcagatgtaagaagcccgatccacattgcataagtggacccagctgccagatgtgtgggcagctgcagggagtggcccggggtgctgggcccagctgtggttgttcttttctgggtcaggagtgactgcggagtggctgggacgctcctgccgggggaccctcctgccgggggtggccgcttgcctgggggaagacccctttccctttctttttttttttgaggctcaaaaaaaaaatccaaataaagcaccatattcccaccacgccaaattaaccttgacaacaatgttggcgtatttgcgtccagtgctgtttttattaattaaggtaaaatttacatatggtgagatgcatgctcttcagtggagacccagcccctagaaggtccctccagcccttcctgtcggcgtccctccccatctgtggctctgacttaagcaccgtggattgacctctccggctcacgaccttcgaggagtcagaatcctgcagttggagcctttgatgtctggcttcttcatcctatgacttagagcttcatccgtgctgttgtgtgtgtccgtagctccttgctgtctgttccttcgtttttaattgtgagcagtgttcttctgtctgaataaactaagacgcagtttgtccatca

SEQ ID NO: 5782 - DNA, 2075 bp, Homo sapiens
ccacaggagaagacgaaccgggcccagcagccatgtggagacccgggcccacgccgaggagcggctcctgaagaaactcttctccggttacaacaagtggtcccgacccgtggccaacatctcggacgtggtcctcgtccgcttcggcctgtccatcgctcagctcattgacgtggatgagaagaaccagatgatgaccacgaacgtatgggtgaagcaggagtggcacgactacaagctgcgctgggacccagctgactatgagaatgtcacctccatccgcatcccctccgagctcatctggcggccggacatcgtcctctacaacaactgcaggagagcccttttgggcaggagtgcttttcgccatcagaccccatcctggcctttctgggagaatagtgtggactgcagggtgccctggagagggtgctgacggggacttcgcggtcacccacctgaccaaggcccacctgttccatgacgggcgggtgcagtggactcccccggccatttacaagagctcctgcagcatcgacgtcaccttcttccccttcgaccagcagaactgcaccatgaaattcggctcctggacctacgacaaggccaagatcgacctggtgaacatgcacagccgcgtggaccagctggacttctgggagagtggcgagtgggtcatcgtggatgccgtgggcacctacaacaccaggaagtacgagtgctgtgccgagatctacccggacatcacctatgccttcgtcatccggcggctgccgctcttctacaccatcaacctcatcatcccctgcctgctcatctcctgcctcaccgtgctggtcttctacctgccctccgagtgtggcgagaagatcacgctgtgcatctccgtgctgctgtcgctcaccgtcttcctgctgctcatcaccgagatcatcccgtccacctcactggtcatcccactcatcggcgagtacctgctgttcaccatgatcttcgtcaccctgtccatcgtcatcacggtcttcgtgctcaacgtgcaccaccgctcgccacgcacgcacaccatgcccacctgggtacgcagggtcttcctggacatcgtgccacgcctgctcctcatgaagcggccgtccgtggtcaaggacaattgccggcggctcatcgagtccatgcataagatggccagtgccccgcgcttctggcccgagccagaaggggagccccctgccacgagcggcacccagagcctgcacccgccctcaccgtccttctgtgtccccctggatgtgccggctgagcctgggccttcctgcaagtcaccctccgaccagctccctcctcagcagcccctggaagctgagaaagccagcccccacccctcgcctggaccctgccgcccgccccacggcacccaggcaccagggctggccaaagccaggtccctcagcgtccagcacatgtccagccctggcgaagcggtggaaggcggcgtccggtgccggtctcggagcatccagtactgtgttccccgagacgatgccgcccccgaggcagatggccaggctgccggcgccctggcctctcgcaacacccactcggctgagctcccacccccagaccagccctctccgtgcaaatgcacatgcaagaaggagccctcttcggtgtccccgagcgccacggtcaagacccgcagcaccaaagcgccgcccccgcacctgcccctgtcgccggccctgacccgggcggtggagggcgtccagtacattgcagaccacctgaaggccgaagacacagacttctcggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctg

SEQ ID NO: 5783 - DNA, 3623 bp, Homo sapiens
acatgcgtcccgagcccgccagaagctgctaggctgaggctgctgtcccggcgggagctgtggcgcggagcggcccctctgctgcgtctgccctcgttttgtctcacgactcacactcagtgctccattccccaagagttcgcgttccccgcgcggcggtcgagaggcggctgcccgcggtcccgcgcgggcgcggggcgatggcggcgcgggggtcagggccccgcgcgctccgcctgctgctcttggtccagctggtcgcggggcgctgcggtctagcgggcgcggcgggcggcgcgcagagaggattatctgaaccttcttctattgcaaaacatgaagatagtttgcttaaggatttatttcaagactacgaaagatgggttcgtcctgtggaacacctgaatgacaaaataaaaataaaatttggacttgcaatatctcaattggtggatgtggatgagaaaaatcagttaatgacaacaaacgtctggttgaaacaggaatggatagatgtaaaattaagatggaaccctgatgactatggtggaataaaagttatacgtgttccttcagactctgtctggacaccagacatcgttttgtttgataatgcagatggacgttttgaagggaccagtacgaaaacagtcatcaggtacaatggcactgtcacctggactccaccggcaaactacaaaagttcctgtaccatagatgtcacgtttttcccatttgaccttcagaactgttccatgaaatttggttcttggacttatgatggatcacaggttgatataattctagaggaccaagatgtagacaagagagatttttttgataatggagaatgggagattgtgagtgcaacagggagcaaaggaaacagaaccgacagctgttgctggtatccgtatgtcacttactcatttgtaatcaagcgcctgcctctcttttataccttgttccttataataccctgtattgggctctcatttttaactgtacttgtcttctatcttccttcaaatgaaggtgaaaagatttgtctctgcacttcagtacttgtgtctttgactgtcttccttctggttattgaagagatcataccatcatcttcaaaagtcatacctctaattggagagtatctggtatttaccatgatttttgtgacactgtcaattatggtaaccgtcttcgctatcaacattcatcatcgttcttcctcaacacataatgccatggcgcctttggtccgcaagatatttcttcacacgcttcccaaactgctttgcatgagaagtcatgtagacaggtacttcactcagaaagaggaaactgagagtggtagtggaccaaaatcttctagaaacacattggaagctgcgctcgattctattcgctacattacaagacacatcatgaaggaaaatgatgtccgtgaggttgttgaagattggaaattcatagcccaggttcttgatcggatgtttctgtggacttttcttttcgtttcaattgttggatctcttgggctttttgttcctgttatttataaatgggcaaatatattaataccagttcatattggaaatgcaaataagtgaagcctcccaagggactgaagtatacatttagttaacacacatatatctgatggcacctataaaattatgaaaatgtaagttatgtgttaaatttagtgcaagctttaacagactaagttgctaacctcaatttatgttaacagatgatccatttgaacagttggctgtatgactgaagtaataactgatgagatacatttgatcttgtaaaaatagcaaaatattatctgaactggactagtgaaaaatctagtatttgtatcctggcaaataatactaatttataatccacagtaaagttcatcctttgactgtgctggagaattccagttgtatttgaagactgattttaaaacttttctgcatttggtaaaggtatgtaaactttcctgtactcactgagtaacagctaatctttaatataatattatactgctatatttaaaaagctgactacttgatataattacttaatgtgatgcttgatataataattacttaatgtggccgggcacggtggctcacacctgtaatcccagcactttgggaggtcgaggtgggcgtatcacctgaggttgggagttcgagaccagcctgaccaacgtggagaaaccccgtctctactaaaaatatgaaattagccagggtggtggtgcacacctgtaatcccagctacctgggaggctgcggcaggagaatcgcttgaacccaggtggcggaggttgcggtgagctgagatcacgccattgcactccagcctgggcaacaagagcaaaactcagtctcaaataataataataacaacaacttaatgtgctgctgcttttccataaccaacattttaaaaataaatgaaaaacaggaattgggaactcctttaaggcttactttattctttagatgcttaattattgtgttaactatttctgtagcttagcttccactgtaaagtcatacagtagacaactcctgtggacacgcagtagcatatccttaacattaatttcagtcctcttgtccacatttcccacaattaatagaaccatcttctatataaattgtggtagtatctctttatccttgatcttagaatagtcagtccactacaattacatgaaccccatttaaaaaacatatttagggccgggggcagtggctcacatctgtaatccaagcactttgggaggctgaggcaggtggatcaccagaggttaggagttcgagactagcctgaccaacatggtgaagccccgtctctactaagaatacaaaaaattagtcgggcatggtagcaggcgcctgtagtcccagctactcaagaggctgaggcaggagaatcgcttgaacctgggaggtggaggctgcagtgagccgagactgcgccattgcactccagcctggcaacaagagcaaaactctgtctcaaacatattttggtctaaatcattctgtgagaaaacaatcttctaatatgaaacacagtattctaatttggtatatgcacactgttatatacctgtaatatttcagttttctctccttcattctaacaattacaataatagaatcttagagttgcaagggcctttagatgtaatcaatcttagcctattactagtacagcgtaaatgatttagtacagtataatgtatcacagttaaaacagttaaattccatctctaaatgtcaccacttcaggtgtgaccaggtagcaaacactgacagaaaccctcgttcaatttagaactcttagctgttgagatcacaaacacctcatttatttataataagtaacctatctaagttcaagccaatgctctttggaaggcggaggagaccctatctaatttgcatttaatcgtaggcaggtgtttaatgccatttaatgagtgaaagcctggtgtgatgaatttagattgcctgccagctacctaccttagttcgtatacatccctgatccctcttatactaccattactgttacttatgatttttatatataaatttttatcgaca

SEQ ID NO: 5784 - DNA, 2400 bp, Homo sapiens
agaaagatctcagccactcacaggtgttcatcctcccggggtcctgtctgccccagcatttcttttctgcttttcttcccctttcttgcatgaagagacatctaggctgtcaggaaatgtgatgactcatctgacatcagatcgaatcttttttattcgcccttcatgtctgcctcagtctctgatcctggtaataaccgtgtgaagtcccggggatgttttgatttctgagaagacacacacggattgcagtgggcttctgatgatgtcaaggttggatgcatgtggctgactgatagctctttgttttccacaatcctttgcctaggaaaaaggaatccaagtgtgttttaaccatgctgaccagcaaggggcagggattccttcatgggggcttgtgtctctggctgtgtgtgttcacacctttctttaaaggctgtgtgggctgtgcaactgaggagaggctcttccacaaactgttttctcattacaaccagttcatcaggcctgtggaaaacgtttccgaccctgtcacggtacactttgaagtggccatcacccagctggccaacgtggatgaagtaaaccagatcatggaaaccaatttgtggctgcgtcacatctggaatgattataaattgcgctgggatccaatggaatatgatggcattgagactcttcgcgttcctgcagataagatttggaagcccgacattgttctctataacaatgctgttggtgacttccaagtagaaggcaaaacaaaagctcttcttaaatacaatggcatgataacctggactccaccagctatttttaagagttcctgccctatggatatcacctttttcccttttgatcatcaaaactgttccctaaaatttggttcctggacgtatgacaaagctgaaattgatcttctaatcattggatcaaaagtggatatgaatgatttttgggaaaacagtgaatgggaaatcattgatgcctctggctacaaacatgacatcaaatacaactgttgtgaagagatatacacagatataacctattctttctacattagaagattgccgatgttttacacgattaatctgatcatcccttgtctctttatttcatttctaaccgtgttggtcttttaccttccttcggactgtggtgaaaaagtgacgctttgtatttcagtcctgctttctctgactgtgtttttgctggtcatcacagaaaccatcccatccacatctctggtggtcccactggtgggtgagtacctgctgttcaccatgatctttgtcacactgtccatcgtggtgactgtgtttgtgttgaacatacactaccgcaccccaaccacgcacacaatgcccaggtgggtgaagacagttttcctgaagctgctgccccaggtcctgctgatgaggtggcctctggacaagacaaggggcacaggctctgatgcagtgcccagaggccttgccaggaggcctgccaaaggcaagcttgcaagccatggggaacccagacatcttaaagaatgcttccattgtcacaaatcaaatgagcttgccacaagcaagagaagattaagtcatcagccattacagtgggtggtggaaaattcggagcactcgcctgaagttgaagatgtgattaacagtgttcagttcatagcagaaaacatgaagagccacaatgaaaccaaggaggtagaagatgactggaaatacgtggccatggtggtggacagagtatttctttgggtatttataattgtctgtgtatttggaactgcagggctatttctacagccactacttgggaacacaggaaaatcttaaaatgtattttcttttatgttcagaaatttacagacaccatatttgttctgcattccctgccacaaggaaaggaaagcaaaggcttcccacccaagtcccccatctgctaaaactgatggctacatggaaaaagaggactttcttgcacattaggaagcagaatatcctccagtgtagcacagggggagaagtgagaagtgttatgacattagtgccctgattgggcagcacccacggctacagtatcaggtcaggtttctcgtgtctgtgtgtttggcttctaaagacaagaatgacttacaatacagcctaattatgtaattaacatcaagccacactaaaaagttctgctgtacctccagtggatgctgtttctcagtattatgacatgtgacaggtgaactctgggaattggaccatgcaacatttgtgaactgtttgcaacactttgtgaactattgcatccttgatttcttgtgcatgtctctgtaatgtaactcaccctcctcagcattatttgatacactgattgttagttttaaaaaaaaaaaaaaaaaaa

SEQ ID NO: 5785 - DNA, 1872 bp, Homo sapiens
agtctctgatcctggtaataaccgtgtgaagtcccggggatgttttgatttctgagaagacacacacggattgcagtgggcttctgatgatgtcaaggttggatgcatgtggctgactgatagctctttgttttccacaatcctttgcctaggaaaaaggaatccaagtgtgttttaaccatgctgaccagcaaggggcagggattccttcatgggggcttgtgtctctggctgtgtgtgttcacacctttctttaaaggctgtgtgggctgtgcaactgaggagaggctcttccacaaactgttttctcattacaaccagttcatcaggcctgtggaaaacgtttccgaccctgtcacggtacactttgaagtggccatcacccagctggccaacgtgatctggaatgattataaattgcgctgggatccaatggaatatgatggcattgagactcttcgcgttcctgcagataagatttggaagcccgacattgttctctataacaatgctgttggtgacttccaagtagaaggcaaaacaaaagctcttcttaaatacaatggcatgataacctggactccaccagctatttttaagagttcctgccctatggatatcacctttttcccttttgatcatcaaaactgttccctaaaatttggttcctggacgtatgacaaagctgaaattgatcttctaatcattggatcaaaagtggatatgaatgatttttgggaaaacagtgaatgggaaatcattgatgcctctggctacaaacatgacatcaaatacaactgttgtgaagagatatacacagatataacctattctttctacattagaagattgccgatgttttacacgattaatctgatcatcccttgtctctttatttcatttctaaccgtgttggtcttttaccttccttcggactgtggtgaaaaagtgacgctttgtatttcagtcctgctttctctgactgtgtttttgctggtcatcacagaaaccatcccatccacatctctggtggtcccactggtgggtgagtacctgctgttcaccatgatctttgtcacactgtccatcgtggtgactgtgtttgtgttgaacatacactaccgcaccccaaccacgcacacaatgcccaggtgggtgaagacagttttcctgaagctgctgccccaggtcctgctgatgaggtggcctctggacaagacaaggggcacaggctctgatgcagtgcccagaggccttgccaggaggcctgccaaaggcaagcttgcaagccatggggaacccagacatcttaaagaatgcttccattgtcacaaatcaaatgagcttgccacaagcaagagaagattaagtcatcagccattacagtgggtggtggaaaattcggagcactcgcctgaagttgaagatgtgattaacagtgttcagttcatagcagaaaacatgaagagccacaatgaaaccaaggaggtagaagatgactggaaatacgtggccatggtggtggacagagtatttctttgggtatttataattgtctgtgtatttggaactgcagggctatttctacagccactacttgggaacacaggaaaatcttaaaatgtattttcttttatgttcagaaatttacagacaccatatttgttctgcattccctgccacaaggaaaggaaagcaaaggcttcccacccaagtcccccatctgctaaaactgatggctacatggaaaaagaggactttcttgcacattaggaagcagaatatcctccagtgtagcacagggggagaagtgagaagtgttatgacattagtgccctgattgggcagcacccacggctacagtatcaggtc

SEQ ID NO: 5786 - DNA, 5669 bp, Homo sapiens
gagccgagcggcgaggtgcctctgtggccgcaggcgcaggcccgggcgacagccgagacgtggagcgcgccggctcgctgcagctccgggactcaacatgcgctgctcgccgggaggcgtctggctggcgctggccgcgtcgctcctgcacgtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatgtcttggacagatcactatttacagtggaatgtgtcagaatatccaggggtgaagactgttcgtttcccagatggccagatttggaaaccagacattcttctctataacagtgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacagtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaaaaaaaaagacagactgttggtcttactaaggatgtttttaccagcctgcctgacttctgcaaacctaccctgtcaaggagatcaaagggacgcaggtttctgtttattctgaacaagggccaggccccgcggagtgtctttggtggatcccagataactcctaggtgctgctctcagacactgaggagttgagcaaatctgttctattctgcagaacccacaggacaaataagagttctactagaattaacagcccaaaagaatagctacagctaagtgaagccacttacgtgggctttaaaaaaataatgtgttagctgattcacatgcactggagttaattagtcttagaaatgtgtgcatccatacaaatgcacaacataaagtgaacatattcctaggccctttctgcctgtgtcagggccaggaagtagaggctgggaactcttctggtccccagtatggcaggcgccagggaggggatggtgtggcccatcccttctctggatacctggccagtggcaggcagcagggaggagctggccgaccctcagtgactgacaagccagcaattctgagttctggcctttgggagtctgcctgctccaagccagtccaccccagctgcagccccaaaagctggctcaaagtccttgggtggattcactggagatgggcaacttaaaacaagagaaactttaatttttaaacctaagtgatgatacagctcttcccttagattatcgcccaggctggagtgcagtggcatgatctcagctcactgcaagctccacctcctgggttcatgccattctcctgcctcagcctccccccgagtaactgggaatacaggcgcccgccaccatgcctggctaattttttgtatttttagtagagatagggtttcatcatgttagccaggatggtctcattcttattctttaatgagatcagagggtaattcaccaagaaagacctctcctgttccattgtgtcatccaacaactgctcagagctcaaaattatagaaggcttctgagcccctagagatttttaatttgcttctaatccctgaggtgggaacatcatgagggaagatttgattttcagagttaaataaattgtatgtgcttttccagccatctggctcactcatttctgggtaatgcacatgactttgtttgcactggaggaagatggaagcttgcgtgtgtgcggtgtgtgtgtgtgtgtaagtgtgaggtaccttgtgtgtgacaagagacctcacttacgagaaagttggtggatcaggacattccagcctcaggcggcttggagcaggatcattcctcagcaggcattccttccacatgctatggatgaaccatgcacaagattttcggtttttttttttttttctgttacagtgtctttagaaacaagtagaagtgttttgatatataaaaggaatgcttcatttcttatcattatcccaaaattgatccctcccacatttttgctttaaaaagaaacctttttggttttgtattttatacaggaacacaaaatgcaaacaagttgtgcatattttggactctcaaataacttctctgtcctttaataaagtaataataaggaatagatgtgcacatagttagaaaagtatgagtggttaaaaacaacagtctcccatactgcctgttttctctctcagaggggaccactaatgagcttctaagggcatttctagaaaggaagaaaagaagataagaggccaaagaaggagggacgggggttatggagagagaccttccctttccagcactaacgctctgtgaagggcgctgcaccttgcattcttcatgtggtgttttgtcttagaggtcgtcccataataacatataaagatctacctcattcctcctagtagctgcttagcattccattatctcagcggactatcatttatttgaatagccttttattggtgaacatatggatacttccagtttttatttttatatacaaatctataattggcatacttgtacatacatcttgacatagttttgtgactaaaacggtataaattccaacttagaaatggaattgctgggtttaaggctacatgtatttaaaattttgatagctattgccagattatcttctagaaactgatcgaaggatgtaactccatcaagagtacaataaaaggcccaatttctcagctttctataatagcactgggtattttcaaacttaatgtttttcccaatataattggtgaaacatgatatttacgaatattattctgattttggtttattttgtgtataaaatgggacatcttttaaaatttttttgtagttttaattttgatacatttatatattttacccagttcctaattgggttatttggctttttcttaatttgctcatgcactttgggacatttttgtcttatgtctttaaaatatttttatcatttgtctttcgatgttatttattgatttccttatttattggcatagagtttaaatttttatgttgtcaatttgtgagtatttttctttgtcgatcgtgggatttgtttccagtttttaaaagccttcctcattctgagattataaatagacttactcgcattttcttctgaaactttatggttttattggtttaccttcacatcttcagactccctggaattcatttgttgcaggacatgagggaaaaatccatactttttcctcgaaatggtggtcagcagtatcaataaatatgtaataatgcatttctaaaatacagtcatagtgttttccccagttgttcaaaatgcagccttatttgtaaactaaatttctttaagtgtttggttctgtttctgttctatttatctctatgaatgcctttcatttctaaagcattattcatactaatatcagtattttcaagtcaacactcccatcaactctgaatctctctctcatatgaatcttttttcaattagagtcacaatgaatttacagattgagtcttcctattcaaaagcatgaaatcttgtgtttaagtctaattttatgtaacttagtagtgttttatgattttgttcactaaggtgctttgaatttatagtttatttctagatgttttatcatttggctatcattttcaatagaatgatttattccactttattttctattttatcccattgtataagaaagtagttggtttttatgtatgaatgttataatcaaccacaaattgtgattcctacttgtttctaaggtatacttttgacttctcctttccaatgtgtctcttatttctttcttgtatctagttgatttgagatcagtgttgagtcacagtgattcaggtggcatgcttatcttgttcgtgacatcagtgggacgttttaatgtctcagcgtttaacttgtatgaagacatgtattttccttgccataataaaaaagtatctgtgtgttctcaaa

SEQ ID NO: 5787 - DNA, 773 bp, Homo sapiens
atgcaaaaatattgcatctaccagcattttcagttccaattgctaatccagcatttgtggatagctgcaaactgtgatatatgggccaaggttgctcgggtgattggtttactggcttcgcacaaaactgatctccaggaaaatacacctgttgttgaggccttccctaacagtcccagaactcctacattgcctggtgtgctgacctaaagccctcattaagaccagtaacaaatcaagcctatcttatcaactgacaacacattctggaaccatggcgtgtccatggataagacatgaagtccttctttcaagacttggttttctggtactggaaaataccaatatggataaaagaccttcaaagctgctacgatgggtaaggaacaatgcacacagtataccattaaggcaaagaagatagtcttaatcctgtatgaaatgccaatgaagatgtaattaatgaatagacatttcattgaaatgaaatcaaaagacattttccttctctgacataacagagtagaactctctagtaagaacacaaaactgaccagcctgaccaatgtgataaaaccccctgtctctactaaaaagacaaaaattagccatgcatggtagcagatgcttgtaatcccagctactcaagaggctcaggcatgagaatctcttgaacccaaaaggtggaggctgcagtgagtcgagatcgcacaactgcacttcaccctgggcgacaaagcaagactttgttttttaaaaaaaagaagaagaag

SEQ ID NO: 5788 - DNA, 1239 bp, Homo sapiens
atgcaaaaatattgcatctaccagcattttcagttccaattgctaatccagcatttgtggatagctgcaaactgtgatattgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacagtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaa

SEQ ID NO: 5789 - DNA, 516 bp, Homo sapiens
ggccgcaggcgcaggcccgggcgacagccgagacgtggagcgcgccggctcgctgcagctccgggactcaacatgcgctgctcgccgggaggcgtctggctggcgctggccgcgtcgctcctgcacgtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatgtcttggacagatcactatttacagtggaatgtgtcagaatatccaggggtgaagactgttcgtttcccagatggccagatttggaaaccagacattcttctctataacagcagttatgaccaacagcaggaagtgctggcctatgggatgcactgctggagcccacagtttggacccacatcctcgtctatgttccctgttgtg

SEQ ID NO: 5790 - DNA, 1855 bp, Homo sapiens
atgaccaacagcaggaagtgctggcctatgggatgcactgctggagcccacagtttggacccacatcctcgtctatgttccctgttgtgcattggagagttctgtggcagagatggctgcagtgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacagtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacatt

SEQ ID NO: 5791 - DNA, 3428 bp, Homo sapiens
aaaggcgcgcgagccgagcggcgaggtgcctctgtggccgcaggcgcaggcccgggcgacagccgagacgtggagcgcgccggctcgctgcagctccgggactcaacatgcgctgctcgccgggaggcgtctggctggcgctggccgcgtcgctcctgcacggtaaagccactgcctccccgccctccactcctccgtgggatcccgggcacatcccgggcgcctctgtgcgccccgcgcctgggccagtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatgtcttggacagatcactatttacagtggaatgtgtcagaatatccaggggtgaagactgttcgtttcccagatggccagatttggaaaccagacattcttctctataacagtgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacagtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaaaaaaaaagacagactgttggtcttactaaggatgtttttaccagcctgcctgacttctgcaaacctaccctgtcaaggagatcaaagggacgcaggtttctgtttattctgaacaagggccaggccccgcggagtgtctttggtggatcccagataactcctaggtgctgctctcagacactgaggagttgagcaaatctgttctattctgcagaacccacaggacaaataagagttctactagaattaacagcccaaaagaatagctacagctaagtgaagccacttacgtgggctttaaaaaaataatgtgttagctgattcacatgcactggagttaattagtcttagaaatgtgtgcatccatacaaatgcacaacataaagtgaacatattcctaggccctttctgcctgtgtcagggccaggaagtagaggctgggaactcttctggtccccagtatggcaggcgccagggaggggatggtgtggcccatcccttctctggatacctggccagtggcaggcagcagggaggagctggccgaccctcagtgactgacaagccagcaattctgagttctggcctttgggagtctgcctgctccaagccagtccaccccagctgcagccccaaaagctggctcaaagtccttgggtggattcactggagatgggcaacttaaaacaagagaaactttaatttttaaacctaagtgatgatacagctcttcccttagattatcgcccaggctggagtgcagtggcatgatctcagctcactgcaagctccacctcctgggttcatgccattctcctgcctcagcctccccccgagtaactgggaatacaggcgcccgccaccatgcctggctaattttttgtatttttagtagagatagggtttcatcatgttagccaggatggtctcattcttattctttaatgagatcagagggtaattcaccaagaaagacctctcctgttccattgtgtcatccaacaactgctcagagctcaaaattatagaaggcttctgagcccctagagatttttaatttgcttctaatccctgaggtgggaacatcatgagggaagatttgattttcagagttaaataaattgtatgtgcttttccagcca

SEQ ID NO: 5792 - DNA, 1785 bp, Homo sapiens
cgtggagcgcgccggctcgctgcagctccgggactcaacatgcgctgctcgccgggaggcgtctggctggcgctggccgcgtcgctcctgcacgtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacgctctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacagtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcact

SEQ ID NO: 5793 - DNA, 2276 bp, Homo sapiens
atgcaatgcaagcctgagctctcccgccataaggctgcagcggtgtgggctccttgtgcccagatcctttgtattcatagggggaagtggaagaccacgctgcctgactgagactttattatagaggctcaggaaaaagatgaactggtcccattcctgcatctccttttgctggatctactttgctgcttccagactgagagctgcagagacggcagatggaaaatatgctcagaagttgtttaatgacctttttgaagattattctaatgctcttcgtccagtggaagatacagataaagtcctgaatgtgaccctgcagattacgctctctcagattaaggatatggatgaaagaaaccaaattctgactgcttatttgtggatccgccaaatctggcacgatgcctatctcacgtgggaccgagatcagtacgatggcctagactccatcaggatccccagtgacctcgtgtggaggccagacatcgtcttatataacaaggctgatgatgaatcttcagagcctgtgaacaccaatgtggtcctgcggtatgatgggctgatcacctgggatgcaccggccatcaccaaaagctcctgtgtggtggatgtcacctacttcccttttgacaaccagcagtgcaacctgacttttggttcctggacctacaatggcaatcaggtggacatattcaacgccttggacagcggagatctctctgacttcattgaagatgtggaatgggaggtccatggcatgcccgctgtgaagaatgtgatctcctatggctgctgctctgagccttacccggatgtcacattcaccctccttctgaagaggaggtcctcgttctatatcgtcaacctcctcatcccatgcgtcctcatatcttttctggctcctctgagtttttatctcccagcagcctccggagaaaaggtctccctgggagtgaccatcctgttggccatgactgtatttcagctaatggtggcagaaatcatgccggcctcagaaaatgtgcccctgataggtaaatactacatagccacgatggccctgatcacagcctccactgcgttgaccatcatggtgatgaatatccacttctgtggggccgaggcccggccggtgccacactgggccagggtggtcatcctgaaatacatgtccagggtcttgtttgtctatgatgtgggtgaaagctgcctcagcccgcaccacagtagagagcgggaccacctcacgaaagtttatagcaaactcccagagtctaacctgaaagcagccaggaacaaagacctttccagaaagaaggacatgaacaaacgcttaaagaacgacctgggctgccagggtaagaaccctcaggaggccgagagttactgtgcacagtacaaagtgctgacgaggaatattgagtacatcgccaagtgcctcaaagaccacaaggccaccaattccaaggggagtgaatggaagaaggtggcgaaagtcatagaccgattcttcatgtggatttttttcattatggtgtttgtgatgactattttgatcatagcaagagcggattagtcacagatattggctttgctatctgggtagaaattaatacaattccctgtgatctattccaatgttcttccaagatttttgttcatctataatttaggggttatgttgtctgtgctttttatttttagcttcaaatgaatgtcgaagctatctgctctgttaaattaagcagaagaaccaaaatttcaagggtaggaagatggaagaaatagggaaagagcccttttatagcccaccgtagtggtgggtgactggcctctagtttatataattatttacctctttggcagtacagataacaaaatacactttactggtaaaatttaaaacaaaaaaggcaaaacaaaacaaactcattttccccttagttcccattaaaatatgcatttgaaaaatgaaatagtcatatatatattagtgtgatttaagtctcaatggtaccttattcaggcatagtgcatttgaagtcatatctcaaatagtggaataaaaggttttgtcccatgtaaagaaagtctaagcatcagctgtttaatggggaaaagaactttcttcataatggtgatgtcgtatatgttggttatgttttatataaacccaaaagatgaagtcattcctgcatttaccctttgattaaaatatgatagatgaagctgttcctgcatttagtcttgtattaaaataaggtgattagcaa

SEQ ID NO: 5794 - DNA, 2557 bp, Homo sapiens
gtcacttcccctgtgctggcggtcccagcggctctctgagcgaagtcactgagcgagccgccaggctatgaccccaggggctctgctgatgctgctgggggcgctgggggcgccgctcgccccaggcgtccgcggctcggaggcggagggtcgactccgggagaaacttttctctggctatgatagctccgtgcggccagcgcgggaggtgggagaccgtgtcagggtcagcgttggtctcatcctggcgcaactcatcagcctgaacgagaaggatgaagagatgagcacaaaggtgtacttagacctggagtggactgactacaggctgagctgggaccctgcggagcacgacggcatcgattcgctccgcatcacggcggaatccgtgtggctccctgacgtggtgctactgaacaacaatgatgggaattttgacgtggctctggacattagcgtcgtggtgtcctccgacggctccgtgcgttggcaacccccgggcatctatcgcagcagctgcagcatccaggtcacctacttccccttcgactggcagaattgcactatggtgttcagctcctacagctacgacagctcggaggtcagcctgcagacaggcctgggtcctgacgggcaagggcatcaggaaatccacattcatgaagggactttcattgagaatggccagtgggagattatccacaagccctctcggctaatccagcctccaggcgatcctaggggagggagggaaggacagcgccaggaagtcatcttctacctcatcatccgccgcaagcctctcttctacctggtcaacgtcattgccccatgcatcctcatcactcttctggccatcttcgtcttctacctgccaccagatgcaggagagaagatggggctctcaatctttgccctgctgacccttactgtgttcctgctgctgctggctgacaaagtacctgagacctcactatcagtacccattattatcaagtacctcatgtttaccatggtcctcgtcaccttctcagtcatccttagtgtcgtggttctcaacctgcaccaccgctcaccccacacccaccaaatgcccctttgggtccgtcagatcttcattcacaaacttccgctgtacctgcgtctaaaaaggcccaaacccgagagagacctgatgccggagccccctcactgttcttctccaggaagtggctggggtcggggaacagatgaatatttcatccggaagccgccaagtgattttctcttccccaaacccaataggttccagcctgaactgtctgcccctgatctgcggcgatttatcgatggtccaaaccgggctgtggccctgcttccggagctacgggaggtcgtctcctctatcagctacatcgctcgacagctgcaggaacaggaggaccacgatgcgctgaaggaggactggcagtttgtggccatggtagtggaccgcctcttcctgtggactttcatcatcttcaccagcgttgggaccctagtcatcttcctggacgccacgtaccacttgccccctccagacccctttccttgaagactggagggttgagacccaggccccctgccagttgaagtgagagtttggtgatactgtcaagccctatccttctctgcctcttaactccttcacgaggaatctgggcctcttatttcgtttctggggactgcattggactgagggctgggtaggcaggtgtcttggacccacctgaaatgcagtatcatctgatttactctttgggatcttgaagaagctcttttgggtatcaacacctaggtcgccagtgaaatagaacacagaacaggaactagattataagccttatgaggtcaagaaatgtgacttggccgggcgcggtggctcacgcctgtaatcccagcactttgggaggccaaggcgggcggatcacctgaggtcgggagtttgagaccagcccgaccaacatggagaaaccctgtctctactaaaaatacaaaattagccaggtgtggtggtacatgcctgtaatcccagctactagggaggctgaggcaggagaatcactcgaacccgggaggcagaggttgcagtgagtcaagatcacgccattgcactccagcctgggcaacaagagcgaaactccatctcaaaaaaaaaaaagtgtcttgttcactgcagcatgcccagtgccacgcacaggtgctgacctatagtaagtgcttaacatttgttgaataggggaaagaaatttccggaagtaaatacagcaattaataatgtttataagctgggcatggtcgctcaggccagtaatcccagtgacttaggaggctgaggtgggaggattacttgaaacccacagtttgagaccagcctgggcaacatagtgagaccctgtctctaaaaaaataaaaatagaaataaagtagtgcttattgtttgcatgttgggtcttgtggtcgttttctttttacctttctgtaatttattatgttttgtaatgtgtactatctctgggattaaaaaaagttatttcta

SEQ ID NO: 5795 - DNA, 1604 bp, Homo sapiens
gagatggaccagcctttggtgaagattggatcgaaatcagaccaatggacaagctctggccgtgggtggtggacgggcctggagtagaactggaacgagaaggatgaagagatgagcacaaaggtgtacttagacctggagtggactgactacaggctgagctgggaccctgcggagcacgacggcatcgattcgctccgcatcacggcggaatccgtgtggctccctgacgtggtgctactgaacaacaatgatgggaattttgacgtggctctggacattagcgtcgtggtgtcctccgacggctccgtgcgttggcaacccccgggcatctatcgcagcagctgcagcatccaggtcacctacttccccttcgactggcagaattgcactatggtgttcagctcctacagctacgacagctcggaggtcagcctgcagacaggcctgggtcctgacgggcaagggcatcaggaaatccacattcatgaagggactttcattgagaatggccagtgggagattatccacaagccctctcggctaatccagcctccaggcgatcctaggggagggagggaaggacagcgccaggaagtcatcttctacctcatcatccgccgcaagcctctcttctacctggtcaacgtcattgccccatgcatcctcatcactcttctggccatcttcgtcttctacctgccaccagatgcaggagagaagatggggctctcaatctttgccctgctgacccttactgtgttcctgctgctgctggctgacaaagtacctgagacctcactatcagtacccattattatcaagtacctcatgtttaccatggtcctcgtcaccttctcagtcatccttagtgtcgtggttctcaacctgcaccaccgctcaccccacacccaccaaatgcccctttgggtccgtcagatcttcattcacaaacttccgctgtacctgcgtctaaaaaggcccaaacccgagagagacctgatgccggagccccctcactgttcttctccaggaagtggctggggtcggggaacagatgaatatttcatccggaagccgccaagtgattttctcttccccaaacccaataggttccagcctgaactgtctgcccctgatctgcggcgatttatcgatggtccaaaccgggctgtggccctgcttccggagctacgggaggtcgtctcctctatcagctacatcgctcgacagctgcaggaacaggaggaccacgatgcgctgaaggaggactggcagtttgtggccatggtagtggaccgcctcttcctgtggactttcatcatcttcaccagcgttgggaccctagtcatcttcctggacgccacgtaccacttgccccctccagacccctttccttgaagactggagggttgagacccaggccccctgccagttgaagtgagagtttggtgatactgtcaagccctatccttctctgcctcttaactccttcacgaggaatctgggcctcttatttcgtttctggggactgcattggactgagggctgggtaggcaggtgtcttggacccacctgaaatgcagtatcatctgatttactct

SEQ ID NO: 5796 - DNA, 5867 bp, Homo sapiens
ctcctccccctcaccgtcccaattgtattccctggaagagcagccggaaaagcctccgcctgctcataccaggataggcaagaagctggtttctcctcgcagccggctccctgaggcccaggaaccaccgcggcggccggcaccacctggacccagctccaggcgggcgcggcttcagcaccacggacagcgccccacccgcggccctccccccggcggcgcgctccagccggtgtaggcgaggcagcgagctatgcccgcggcatggcccggcgctgcggccccgtggcgctgctccttggcttcggcctcctccggctgtgctcaggggtgtggggtacggatacagaggagcggctggtggagcatctcctggatccttcccgctacaacaagcttatccgcccagccaccaatggctctgagctggtgacagtacagcttatggtgtcactggcccagctcatcagtgtgcatgagcgggagcagatcatgaccaccaatgtctggctgacccaggagtgggaagattatcgcctcacctggaagcctgaagagtttgacaacatgaagaaagttcggctcccttccaaacacatctggctcccagatgtggtcctgtacaacaatgctgacggcatgtacgaggtgtccttctattccaatgccgtggtctcctatgatggcagcatcttctggctgccgcctgccatctacaagagcgcatgcaagattgaagtaaagcacttcccatttgaccagcagaactgcaccatgaagttccgttcgtggacctacgaccgcacagagatcgacttggtgctgaagagtgaggtggccagcctggacgacttcacacctagtggtgagtgggacatcgtggcgctgccgggccggcgcaacgagaaccccgacgactctacgtacgtggacatcacgtatgacttcatcattcgccgcaagccgctcttctacaccatcaacctcatcatcccctgtgtgctcatcacctcgctagccatccttgtcttctacctgccatccgactgtggcgagaagatgacgttgtgcatctcagtgctgctggcgctcacggtcttcctgctgctcatctccaagatcgtgcctcccacctccctcgacgtgccgctcgtcggcaagtacctcatgttcaccatggtgcttgtcaccttctccatcgtcaccagcgtgtgcgtgctcaacgtgcaccaccgctcgcccaccacgcacaccatggcgccctgggtgaaggtcgtcttcctggagaagctgcccgcgctgctcttcatgcagcagccacgccatcattgcgcccgtcagcgcctgcgcctgcggcgacgccagcgtgagcgcgagggcgctggagccctcttcttccgcgaagccccaggggccgactcctgcacgtgcttcgtcaaccgcgcgtcggtgcaggggttggccggggccttcggggctgagcctgcaccagtggcgggccccgggcgctcaggggagccgtgtggctgtggcctccgggaggcggtggacggcgtgcgcttcatcgcagaccacatgcggagcgaggacgatgaccagagcgtgagtgaggactggaagtacgtcgccatggtgatcgaccgcctcttcctctggatctttgtctttgtctgtgtctttggcaccatcggcatgttcctgcagcctctcttccagaactacaccaccaccaccttcctccactcagaccactcagcccccagctccaagtgaggcccttcctcatctccatgctctttcaccctgccaccctctgctgcacagtagtgttgggtggaggatggacgagtgagctaccaggaagaggggcgctgcccccacagatccatccttttgcttcatctggagtccctcctcccccacgcctccatccacacacagcagctccaacctggaggctggaccaactgctttgttttggctgctctccatctcttgtaccagcccaggcaatagtgttgaggaggggagcaaggctgctaagtggaagacagagatggcagagccatccaccctgaggagtgatgggcaaggggccaggaaggggacaggattgtctgctgcctccaagtcatgggagaagaggggtataggacaaggggtggaagggcaggagctcacaccgcaccgggctggcctgacacaatggtagctctgaagggaggggaagagagaggcctgggtgtgacctgacacctgccgctgcttgagtggacagcagctggactgggtgggccccacagtggtcagcgattcctgccaagtagggtttagccgggccccatggtcacagacccctgggggaggcttccagctcagtcccacagccccttgcttctaagggatccagagacctgctccagatcctctttccccactgaagaattctgcaccctctggacttccctcttcttccttcctttctcaggctcaaggtgtggggggcaaggctgagtattaggggagcttctgagttctgaatctttgggtgacctgcttggagtctcaggtccaaatacttgaaatctgtgagaagtccaagttcatgggcttttggaactggaagaactttgtacagccatggattccaacataagccatgttgcagatgaagaaactgacccacacggtgagacaagcacaggtgggtctgactcttcctccctgccctgagatccatctgtcgagtgccctgttttttccccactttgaactgactggttactctaaggaagtgaactgaggatgttagctttaagccaacccagcctctttgtccacagcagagctgaggtgaacagctggaaccctgctacatccgtgctgctccagtctgttctgctcatggctccatccttctggctgtcactcttcctcttccccttcccaaccaaacctgagcagctttgaagcagaacttgggaaggacagggctgctgctgccagcgacacctcagaaagcatagcctcggcttcctgccccatgtgtccctggaagctgtaccctgactctgcttccagaggccagcagatggtgggttacagacgggtcagcctgccaagtgcacctgagggacctgacctgacacaagccattttgtccctagagcccagctgggactcctgcttctctaggcagggcagagggaggagacacagcacaggcacagagcatgggacagggacccccgagtctggattcaagtcctggccctgctagtaactcatgtgagccagcttgagcaagtcccttcatcttgctagagctcagcttccttgcctataaaacgtaggtggcaatgccctcttcctgaggttgctgggaggataaggcagtgcttgtgaaaaagtctagcgctgtacctggcacagagtagatgcttcatgaatgttgagtctgacaggcaactggagctggtgagaatggggtcccctgactgtcatgccagcctccctcccaggcccactcttcccccctcttccctgaggaaaccaagtctcccttatcaggaagagctgggggagctgggaggaacattacaggaacaccagagggagtctagcgggtgggcaggcttctctctgcagccccctcagcagtttcattccattcctgggctgaacccttgccctggccctgcctcccttctgggtcagcacctcctgacacaggtgtgtgctcagggaccccaggctctagtcctgtactggctgtggaagcctatcactgggacaggaagccagtggctgcaggagacaggcctcagcgcatctcgtctgtcaggatgggctcacggacaccttttcttggtagcagggagtgtctctgcactatggaaactttccctcttctagagcggattgggagttgcctgtattatgcctgaaccctccttgaactcatggtcctggggaaggcgtcttggaaccagaaacagcaacaggaaaggagcctccctctgaagggtaggatgccggcctgaggccctccctcttggctctcccagggcctgggctaccccgaggccccagcagctgctgctgtggctgtacttgcttttaatatttcccatacatggctgttgtccaagttaagtcaccaaatggtgctagaggggatggcagagagcagcttgtccagctcctctccatgacccggttaacacacgagtaaacaggcctagagcttgtctgctgtttgacctcttttaagacccggctgtgctgcatctacaaaatgaagatgacagagctagccgaggtcttcagcaaggaagaaaggggtcagtgtatatgaaagggttacctgggcagtgtcattccctccatctctgtacgcagccctttgggaaccatcacaataaggaagaggtgagggcagaggtgaaggatccactgcccaggcaaggtgctaccatgtggtgggagagtgtgaaccctcaagtgcactgggaagctttggggaaccacagtctcttccacccttgggtcgtgtgtcgtcctcttctcttgatgtcagggaagcccctatgcctccttcccgtggtggggctatctctgcagagaatcgggtgcccagcttaatgctgggcaaggactggaggaagctccagatctggaggtggcagagatactggatggaaacctggagcaagggtttgggaggggaagtgaggaaacaggttgagactatctccatcagagatggcaaggccacaggtgatctgagaactatttttgtctgaaaagaaggcatgcacaggctctctgcttttgacaggtggcgttgcagtgggaggaaggcagcttcctggcggggagatagaaatactagaacagctggtaccaagttattgaaaatttaaaagcaaacaagacacagcagcccccaggtggtgtgttctactgaggaaggctacggcagaggaagggcaagaccgtttcccccaatggtcttgaaacggaagaggaaacagggagggctctttggatggtttggggacctggggctgtttgtatcccagtattagctcctgttactaagggtctgctctgcgccaggtcctcagcatgcgttgtctttattccgcgtgacaatcctatgggaaggggcctccacctacgtaacagaaatgcggctcagaaagaccaagtgacagctagtgagtagtgctgggcctgaaccccaaagtccacactcttgctatagccgctgaggcaggcagaagagctccttgggaggaaagtaaggggcattcaaagccttctctgaatcactccccaagccagagtagacctggttccagttgtcccccccttgtttccgggcagagtcaggcaggtgtcataccatccctccccgcccaaccagtgctggccagactcccattcaccgaccttgactagacagcgaacagccaccttttagtattcatcccaacaggtccaggcggtcagtgtgatagccacgcagttcctaagggactgtaggtctaggaatcattaggacactcactcagccaccctcgatgcccccatcttccccacactgcccttggcctccccgctctgcacgcctggagtatttgcactggtctagcctactccaggtcagactcattaggaactcaagattctcgtaaagaaagttgtttccaaagttgtcttgtcactctatttgggggttgggagagagcccgtgggggccagcgttggcgaatacaggaaaaagggagaatgctggagaaactggactcgtgagagcttaaagacatcacaagaatccaaagaaaaagtgagtggtgaca

SEQ ID NO: 5797 - DNA, 2294 bp, Homo sapiens
tgttgctgtcctcttgggttccacttcggattttgaacccctgtattttcttttcaaaacccccttttccagtggaaatgctctgttgttaaaaaggaagaaactgtctttctgaaactgacatcacgatgctcccagattttatgctggttctcatcgtccttggcatcccttcctcagccaccacaggtttcaactcaatcgccgaaaatgaagatgccctcctcagacatttgttccaaggttatcagaaatgggtccgccctgtattacattctaatgacaccataaaagtatattttggattgaaaatatcccagcttgtagatgtggatgaaaagaatcagctgatgacaaccaatgtgtggctcaaacaggaatggacagaccacaagttacgctggaatcctgatgattatggtgggatccattccattaaagttccatcagaatctctgtggcttcctgacatagttctctttgaaaatgctgacggccgcttcgaaggctccctgatgaccaaggtcatcgtgaaatcaaacggaactgttgtctggacccctcccgccagctacaaaagctcctgcaccatggacgtcacgtttttcccgttcgaccgacagaactgctccatgaagtttggatcctggacttatgatggcaccatggttgacctcattttgatcaatgaaaatgtcgacagaaaagacttcttcgataacggagaatgggaaatactgaacgcaaaggggatgaaggggaacagaagggacggcgtgtactcctatccctttatcacgtattccttcgtcctgagacgcctgcctttattctataccctctttctcatcatcccctgcctggggctgtctttcctaacagttcttgtgttctatttaccttcggatgaaggagaaaaactttcattatccacatcggtcttggtttctctgacagttttccttttagtgattgaagaaatcatcccatcgtcttccaaagtcattcctctcattggagagtacctgctgttcatcatgatttttgtgaccctgtccatcattgttaccgtgtttgtcattaacgttcaccacagatcttcttccacgtaccaccccatggccccctgggttaagaggctctttctgcagaaacttccaaaattactttgcatgaaagatcatgtggatcgctactcatccccagagaaagaggagagtcaaccagtagtgaaaggcaaagtcctcgaaaaaaagaaacagaaacagcttagtgatggagaaaaagttctagttgcttttttggaaaaagctgctgattccattagatacatttcgagacatgtgaagaaagaacattttatcagccaggtagtacaagactggaaatttgtagctcaagttcttgaccgaatcttcctgtggctctttctgatagtgtcagtaacaggctcggttctgatttttacccctgctttgaagatgtggctacatagttaccattaggaatttaaaagacataagactaaattacaccttagacctgacatctggctatcacacagacagaatccaaatgcatgtgcttgttctacgaaccccgaatgcgttgtctttgtggaaatggaacatctcctcatgggagaaactctggtaaatgtgctcatttgtggttgccatgagagtgagctgcttttaaagaaagtggagcctcctcagacccctgccttggctttcccagacattcagggagggatcataggtccaggcttgagctcacatgtggccagagtgcacaaaaagctgttgctacttggtggaggaacacctcctagaagcagcaggcctcggtggtgggggaggggggattcacctggaattaaggaagtctcggtgtcgagctatctgtgtgggcagagcctggatctcccaccctgcactggcctccttggtggttttgtctgagctgcaaactggggccgtgttatgcttgttagcaatgggccaggcaaatctcaacaagggtttggggattacactggcaggatagctggcactgcacacttaacaataacacagattccaagttgcctggcctaccgaagcaggtgttattcatggtttattcccagcatgataaggctttcagatggtgaaactggagcccactgtgagctgtgacttcctttaaggtcatgcataccaaaataactcacaatagaaacaaagccctttgctaccagaagtggattcattaatacccattatcttttcctagtaaactagtgtacagaa

SEQ ID NO: 5798 - DNA, 2623 bp, Homo sapiens
ccgccagcaaacctcgggggccaggaccggcgctcactcgaccgcgcggctcacgggtgccctgtgaccccacagcggagctcgcggcggctgccacccggccccgccggccatgaggcgcgcgccttccctggtccttttcttcctggtcgccctttgcgggcgcgggaactgccgcgtggccaatgcggaggaaaagctgatggacgaccttctgaacaaaacccgttacaataacctgatccgcccagccaccagctcctcacagctcatctccatcaagctgcagctctccctggcccagcttatcagcgtgaatgagcgagagcagatcatgaccaccaatgtctggctgaaacaggaatggactgattaccgcctgacctggaacagctcccgctacgagggtgtgaacatcctgaggatccctgcaaagcgcatctggttgcctgacatcgtgctttacaacaacgccgacgggacctatgaggtgtctgtctacaccaacttgatagtccggtccaacggcagcgtcctgtggctgccccctgccatctacaagagcgcctgcaagattgaggtgaagtactttcccttcgaccagcagaactgcaccctcaagttccgctcctggacctatgaccacacggagatagacatggtcctcatgacgcccacagccagcatggatgactttactcccagtggtgagtgggacatagtggccctcccagggagaaggacagtgaacccacaagaccccagctacgtggacgtgacttacgacttcatcatcaagcgcaagcctctgttctacaccatcaacctcatcatcccctgcgtgctcaccaccttgctggccatcctcgtcttctacctgccatccgactgcggcgagaagatgacactgtgcatctcagtgctgctggcactgacattcttcctgctgctcatctccaagatcgtgccacccacctccctcgatgtgcctctcatcggcaagtacctcatgttcaccatggtgctggtcaccttctccatcgtcaccagcgtctgtgtgctcaatgtgcaccaccgctcgcccagcacccacaccatggcaccctgggtcaagcgctgcttcctgcacaagctgcctaccttcctcttcatgaagcgccctggccccgacagcagcccggccagagccttcccgcccagcaagtcatgcgtgaccaagcccgaggccaccgccacctccaccagcccctccaacttctatgggaactccatgtactttgtgaaccccgcctctgcagcttccaagtctccagccggctctaccccggtggctatccccagggatttctggctgcggtcctctgggaggttccgacaggatgtgcaggaggcattagaaggtgtcagcttcatcgcccagcacatgaagaatgacgatgaagaccagagtgtcgttgaggactggaagtacgtggctatggtggtggaccggctgttcctgtgggtgttcatgtttgtgtgcgtcctgggcactgtggggctcttcctaccgcccctcttccagacccatgcagcttctgaggggccctacgctgcccagcgtgactgagggccccctgggttgtggggtgagaggatgtgagtggccgggtgggcactttgctgcttctttctgggttgtggctgatgaggccctaagtaaatatgtgagcattggccatcaaccccatcaaaccagccacagccgtggaacaggcaaggatgggggcctgggctgtcctctctgaatgccttggagggatcccaggaagccccagtaggagggagcttcagacagttcaattctggcctgtcttccttccctgcaccgggcaatggggataaagatgacttcgtagcagcacctactatgcttcaggcatggtgccggcctgcctctccatcaccatctctctccacttccccttgtccagttcctcacacacttctagattcttcccagctcagaggcttggcatttgccatatcatcatctttttttttttcttttaaacggagtcttgctatatcgcccaggctcaagtgattctcctgcctcaacctcccaagtagctgggattacagaaagccgccaccgtgcccagctaatttttgtatttttgttggccaggctgatttcgaactcctgacctcaaatgacccacctgcctcggcctcccaaagtgctaggattacaagtgtgagccactatgcctggccttccctatcttctacctgaaccttcttcctcttcccccagggcttcccaagctctttccacagccacatcagtcagggcatggctccaatccattctttgctccaatgtcacctcctctgagaggccttccctaaccacccaatcattctaaagcagcctccctacagtcacgttaccctgcctccttcctcgagcactcctgtgtacctgtcgctcttatctggtggcatgtatgtcatccacagctcacccactagagtgtgagctccatgagaacagggacctgctccttcacattcgtggtagtatccccagggcctaggacagagcttggcacacagtaggtgctcaataaatgtttgt

SEQ ID NO: 5799 - DNA, 1355 bp, Homo sapiens
ccgccagcaaacctcgggggccaggaccggcgctcactcgaccgcgcggctcacgggtgccctgtgaccccacagcggagctcgcggcggctgccacccggccccgccggccatgaggcgcgcgccttccctggtccttttcttcctggtcgccctttgcgggcgcgggaactgccgcgtggccaatgcggaggaaaagctgatggacgaccttctgaacaaaacccgttacaataacctgatccgcccagccaccagctcctcacagctcatctccatcaagctgcagctctccctggcccagcttatcagcgtgaatgagcgagagcagatcatgaccaccaatgtctggctgaaacaggaatggactgattaccgcctgacctggaacagctcccgctacgagggtgtgaacatcctgaggatccctgcaaagcgcatctggttgcctgacatcgtgctttacaacaagtcgttgaggactggaagtacgtggctatggtggtggaccggctgttcctgtgggtgttcatgtttgtgtgcgtcctgggcactgtggggctcttcctaccgcccctcttccagacccatgcagcttctgaggggccctacgctgcccagcgtgactgagggccccctgggttgtggggtgagaggatgtgagtggccgggtgggcactttgctgcttctttctgggttgtggctgatgaggccctaagtaaatatgtgagcattggccatcaaccccatcaaaccagccacagccgtggaacaggcaaggatgggggcctgggctgtcctctctgaatgccttggagggatcccaggaagccccagtaggagggagcttcagacagttcaattctggcctgtcttccttccctgcaccgggcaatggggataaagatgacttcgtagcagcacctactatgcttcaggcatggtgccggcctgcctctccatcaccatctctctccacttccccttgtccagttcctcacacacttctagattcttcccagctcagaggcttggcatttgccatatcatcatctttttttttttcttttaaacggagtcttgctatatcgcccaggctcaagtgattctcctgcctcaacctcccaagtagctgggattacagaaagccgccaccgtgcccagctaatttttgtatttttgttggccaggctgatttcgaactcctgacctcaaatgacccacctgcctcggcctcccaaagtgctaggattacaagtgtgagccactatgcctggccttccctatcttctacctgaaccttcttcctcttcccccagggcttcccaagctctttccacagccacatcagtca

SEQ ID NO: 5800 - DNA, 2112 bp, Homo sapiens
gggcagatgcacgtcccagtcagagggatgggatggaggggccagtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgaaagaagttgaggagaccctcactaccaatgtgtggatagagcacggctggacagacaaccggctgaagtggaatgctgaagaatttggaaacatcagtgtcctgcgcctccccccggacatggtgtggctcccagagattgtgctggagaacaacaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcagttccctcaagtatacggccaaagagatcaccctgagcctgaaacaggatgccaaggagaaccgcacctaccccgtggagtggatcatcattgatcctgaaggcttcacagagaacggggagtgggagatagtccaccggccggccagggtcaacgtggaccccagagcccctctggacagccccagccgccaggacatcaccttctacctcatcatccgccgcaagcccctcttctacatcatcaacatcctggtgccctgcgtgctcatctccttcatggtcaacctggtcttctacctaccggctgacagtggtgagaagacatcagtggccatctcggtgctcctggctcagtctgtcttcctgctgctcatctccaagcgtctgcctgccacatccatggccatcccccttatcggcaagttcctgctcttcggcatggtgctggtcaccatggttgtggtgatctgtgtcatcgtgctcaacatccacttccgaacacccagcacccatgtgctgtctgagggggtcaagaagctcttcctggagaccctgccggagctcctgcacatgtcccgcccagcagaggatggacccagccctggggccctggtgcggaggagcagctccctgggatacatctccaaggccgaggagtacttcctgctcaagtcccgcagtgacctcatgttcgagaagcagtcagagcggcatgggctggccaggcgcctcaccactgcacgccggcccccagcaagctctgagcaggcccagcaggaactcttcaatgagctgaagccagctgtggatggggcaaacttcattgttaaccacatgagggaccagaacaattacaatgaggagaaagacagctggaaccgagtggcccgcacagtggaccgcctctgcctgtttgtggtgacgcctgtcatggtggtgggcacagcctggatcttcctgcagggcgtttacaaccagccaccaccccagccttttcctggggacccctactcctacaacgtgcaggacaagcgcttcatctagggtgggcctgttggggagccaggagacagcagggtctgagagaggagccacagtccctaatgacacccactcctagccctgaggctcgtgcccctcagactggggaagagtccaaggaagggagggagcagccactcctcaatgctcaatggctcccctgaaatcaagacaggggccacccgagatggtctgagggtggacatcggctacagtgggtgggcaggacgatttggggggaggcccgaggctggctcaggggccagggaggaggccactcagggtggcctcagggggagagctctgataggggtgagacagatagggccccttctctgcttctcctcccccaaggtgtggggtagagcaggcaggaatctgcgccttcactctctggcccctccagcctccctcttcctacctacccttcaacctcaggcttctgaggcctcacctgggactgaggttgaggacacctccctccctccagaccccagagtatcctttcctagctctttctgccttgacc

SEQ ID NO: 5801 - DNA, 3022 bp, Homo sapiens
tccgagctgcggggagtcccagcctgggatctttgcctcatgtccttgggctcctgccctggctggcccgtcccccaccgccatgaggtgtcagattgtgtttccggctgcctcttcccgttgaccccctcctcccccaacacctgtcccctctcccgcccaccctcattccacagccctgtagacaggaggggcagatgcacgtcccagtcagagggatgggatggaggggccagtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgaaagaagttgaggagaccctcactaccaatgtgtggatagagcacggctggacagacaaccggctgaagtggaatgctgaagaatttggaaacatcagtgtcctgcgcctccccccggacatggtgtggctcccagagattgtgctggagaacaacaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcagagaacggggagtgggagatagtccaccggccggccagggtcaacgtggaccccagagcccctctggacagccccagccgccaggacatcaccttctacctcatcatccgccgcaagcccctcttctacatcatcaacatcctggtgccctgcgtgctcatctccttcatggtcaacctggtcttctacctaccggctgacagtggtgagaagacatcagtggccatctcggtgctcctggctcagtctgtcttcctgctgctcatctccaagcgtctgcctgccacatccatggccatcccccttatcggcaagttcctgctcttcggcatggtgctggtcaccatggttgtggtgatctgtgtcatcgtgctcaacatccacttccgaacacccagcacccatgtgctgtctgagggggtcaagaagctcttcctggagaccctgccggagctcctgcacatgtcccgcccagcagaggatggacccagccctggggccctggtgcggaggagcagctccctgggatacatctccaaggccgaggagtacttcctgctcaagtcccgcagtgacctcatgttcgagaagcagtcagagcggcatgggctggccaggcgcctcaccactgcacgccggcccccagcaagctctgagcaggcccagcaggaactcttcaatgagctgaagccagctgtggatggggcaaacttcattgttaaccacatgagggaccagaacaattacaatgaggagaaagacagctggaaccgagtggcccgcacagtggaccgcctctgcctgtttgtggtgacgcctgtcatggtggtgggcacagcctggatcttcctgcagggcgtttacaaccagccaccaccccagccttttcctggggacccctactcctacaacgtgcaggacaagcgcttcatctagggtgggcctgttggggagccaggagacagcagggtctgagagaggagccacagtccctaatgacacccactcctagccctgaggctcgtgcccctcagactggggaagagtccaaggaagggagggagcagccactcctcaatgctcaatggctcccctgaaatcaagacaggggccacccgagatggtctgagggtggacatcggctacagtgggtgggcaggacgatttggggggaggcccgaggctggctcaggggccagggaggaggccactcagggtggcctcagggggagagctctgataggggtgagacagatagggccccttctctgcttctcctcccccaaggtgtggggtagagcaggcaggaatctgcgccttcactctctggcccctccagcctccctcttcctacctacccttcaacctcaggcttctgaggcctcacctgggactgaggttgaggacacctccctccctccagaccccagagtatcctttcctagctctttctgccttgacctctctgcctaggtccctttgggaagttgaggactggagtggaaaggtcaggatcgacatccacaaagacttggggtcagcctgaggttgcacacacaatcctagaggaccagaacgcagcacctctccccaaagggtccctgccccccagcacctactcctctccaaattagggttgtcatgcattatttggggcatacatattctaaaaaatcattcgttgtttctctgaaatttgtcccctatttttatttgctaaatctagcaaccctatcccaaaggcagcctccactcaatcttatcctgagggccaaaggccaaggctgcaggaattgggagacaagggtctgtttgtatggtggtccacctccaagatggccccagtgatgcccagtattcacacccttgtgcagtcccctcactctgtaccagggtgggtctgggtaaccaatagaatgaggcagaagtgatggtacctcacttcccagatttggttaggaaagacactatggcctctttcttgctcattagccctcattctcacatcagttggatctctcactttggggaagccagctggcatgttaaggagccctatggagaggcccacatggcaaggaactaaggcctcctgccaacagccacgtgagtgaatgtggaagtggatcctctgccccagtagggccttcggatgagatcacagcccagtagacatcttatgtgcagccccatgaaagtccctaagccagaaccaccagctaagtgactcctggattcctgacccccagaaactgtgtgagataataaatgtgtgttgttttaagtgacaa

SEQ ID NO: 5802 - DNA, 1325 bp, Homo sapiens
agatgcacgtcccagtcagagggatgggatggaggggccagtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgaaagaagttgaggagaccctcactaccaatgtgtggatagagcacggctggacagacaaccggctgaagtggaatgctgaagaatttggaaacatcagtgtcctgcgcctccccccggacatggtgtggctcccagagattgtgctggagaacaacaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcaggtggtgagaagacatcagtggccatctcggtgctcctggctcagtctgtcttcctgctgctcatctccaagcgtctgcctgccacatccatggccatcccccttatcggcaagttcctgctcttcggcatggtgctggtcaccatggttgtggtgatctgtgtcatcgtgctcaacatccacttccgaacacccagcacccatgtgctgtctgagggggtcaagaagctcttcctggagaccctgccggagctcctgcacatgtcccgcccagcagaggatggacccagccctggggccctggtgcggaggagcagctccctgggatacatctccaaggccgaggagtacttcctgctcaagtcccgcagtgacctcatgttcgagaagcagtcagagcggcatgggctggccaggcgcctcaccactgcacgccggcccccagcaagctctgagcaggcccagcaggaactcttcaatgagctgaagccagctgtggatggggcaaacttcattgttaaccacatgagggaccagaacaattacaatgaggagaaagacagctggaaccgagtggcccgcacagtggaccgcctctgcctgtttgtggtgacgcctgtcatggtggtgggcacagcctggatcttcctgcagggcgtttacaaccagccaccaccccagccttttcctggggacccctactcctacaacgtgcaggacaagcgcttcatctagggtgggcctgttggggagccaggagacagcagggtctgagagaggagccacagt

SEQ ID NO: 5803 - DNA, 952 bp, Homo sapiens
agatgcacgtcccagtcagagggatgggatggaggggccagtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgaaagaagttgaggagaccctcactaccaatgtgtggatagagcacggctggacagacaaccggctgaagtggaatgctgaagaatttggaaacatcagtgtcctgcgcctccccccggacatggtgtggctcccagagattgtgctggagaacaacaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcagagaacggggagtgggagatagtccaccggccggccagggtcaacgtggaccccagagcccctctggacagccccagccgccaggacatcaccttctacctcatcatccgccgcaagcccctcttctacatcatcaacatcctggtgccctgcgtgctcatctccttcatggtcaacctggtcttctacctaccggctgacagtggtgagaagacatcagtggccatctcggtgctcctggctcagtctgtcttcctgctgctcatctccaagcgtctgcctgccacatccatggccatcccccttatcggcaagttcctgctcttcggcatggtgctggtcaccatggttgtggtgatctgtgtcatcgtgctcaacatccacttccgaacacccagcacccatgtgctgtctga

SEQ ID NO: 5804 - DNA, 1828 bp, Homo sapiens
attccacagccctgtagacaggaggggcagatgcacgtcccagtcagagggatgggatggaggggccagtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgggctggacagacaaccggctgaagtggaatgctgaagaatttggaaacatcagtgtcctgcgcctccccccggacatggtgtggctcccagagattgtgctggagaacaacaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcagttccctcaagtatacggccaaagagatcaccctgagcctgaaacaggatgccaaggagaaccgcacctaccccgtggagtggatcatcattgatcctgaaggcttcacagagaacggggagtgggagatagtccaccggccggccagggtcaacgtggaccccagagcccctctggacagccccagccgccaggacatcaccttctacctcatcatccgccgcaagcccctcttctacatcatcaacatcctggtgccctgcgtgctcatctccttcatggtcaacctggtcttctacctaccggctgacagtggtgagaagacatcagtggccatctcggtgctcctggctcagtctgtcttcctgctgctcatctccaagcgtctgcctgccacatccatggccatcccccttatcggcaagttcctgctcttcggcatggtgctggtcaccatggttgtggtgatctgtgtcatcgtgctcaacatccacttccgaacacccagcacccatgtgctgtctgagggggtcaagaagctcttcctggagaccctgccggagctcctgcacatgtcccgcccagcagaggatggacccagccctggggccctggtgcggaggagcagctccctgggatacatctccaaggccgaggagtacttcctgctcaagtcccgcagtgacctcatgttcgagaagcagtcagagcggcatgggctggccaggcgcctcaccactgcacgccggcccccagcaagctctgagcaggcccagcaggaactcttcaatgagctgaagccagctgtggatggggcaaacttcattgttaaccacatgagggaccagaacaattacaatgaggagaaagacagctggaaccgagtggcccgcacagtggaccgcctctgcctgtttgtggtgacgcctgtcatggtggtgggcacagcctggatcttcctgcagggcgtttacaaccagccaccaccccagccttttcctggggacccctactcctacaacgtgcaggacaagcgcttcatctagggtgggcctgttggggagccaggagacagcagggtctgagagaggagccacagtccctaatgacacccactcctagccctgaggctcgtgcccctcagactggggaagagtccaaggaagggagggagcagccactcctcaatgctcaatggctcccctgaaatcaagacaggggccacccgagatggtctgagggtggacatcggctacagtgggtgggcaggacgatttggggggaggcccgaggctggctcaggggccag

SEQ ID NO: 5805 - DNA, 2455 bp, Homo sapiens
cacgcagcaggatggcaagggctccgcttggggtcctgctcctcttggggcttctcggcaggggtgtggggaagaacgaggaactgcgtctttatcaccatctcttcaacaactatgacccaggaagccggccagtgcgggagcctgaggatactgtcaccatcagcctcaaggtcaccctgacgaatctcatctcactgaatgaaaaagaggagactctcaccactagcgtctggattggaatcgattggcaggattaccgactcaactacagcaaggacgactttgggggtatagaaaccctgcgagtcccttcagaactcgtgtggctgccagagattgtgctggaaaacaatattgatggccagttcggagtggcctacgacgccaacgtgctcgtctacgagggcggctccgtgacgtggctgcctccggccatctaccgcagcgtctgcgcagtggaggtcacctacttccccttcgattggcagaactgttcgcttattttccgctctcagacgtacaatgccgaagaggtggagttcacttttgccgtagacaacgacggcaagaccatcaacaagatcgacatcgacacagaggcctatactgagaacggcgagtgggccatcgacttctgcccgggggtgatccgccgccaccacggtggcgccaccgacggcccaggggagactgacgtcatctactcgctcatcatccgccggaagccgctcttctacgtcattaacatcatcgtgccctgtgtgctcatctcgggcctggtgctgctcgcctacttcctgccggcgcaggccggcggccagaaatgcacggtctccatcaacgtcctgctcgcccagaccgtcttcttgttcctcattgcccagaaaatcccagagacttctctgagcgtgccgctcctgggcaggttccttattttcgtcatggtggtcgccacgctcattgtcatgaattgcgtcatcgtgctcaacgtgtcccagcggacgcccaccacccacgccatgtccccgcggctgcgccacgttctcctggagctgctgccgcgcctcctgggctccccgccgccgcccgaggccccccgggccgcctcgcccccaaggcgggcgtcgtcggtgggcttattgctccgcgcggaggagctgatactgaaaaagccacggagcgagctcgtgtttgaggggcagaggcaccggcaggggacctggacggctgccttctgccagagcctgggcgccgccgcccccgaggtccgctgctgtgtggatgccgtgaacttcgtggccgagagcacgagagatcaggaggccaccggcgaggaagtgtccgactgggtgcgcatggggaatgcccttgacaacatctgcttctgggccgctctggtgctcttcagcgtgggctccagcctcatcttcctcggggcctacttcaaccgagtgcctgatctcccctacgcgccgtgtatccagccttagctcgcaccgacttcaatttcccacccatctccagtaggaaattgattttgaaaaagtaggctgccgccaccacggcattatgatcccttccccctgctgatcaatctgcagtttgtgaacttcacaagaatggtgtgtgcccgttccctggcgtgtgtaggcctggccgcagtccaggggtcagcaggaggaaagggttcacataggctctcaggtgccagtcttccagaaagcaaggactgcccttcattcagccttgctgacctcccagcctttctaaggctcagccccacgggactctggtggctgccagcttgtgagctatctatctatattcatttcatagccaaacaggagacccctttgcaggacttgcacacagggaggctgtagccaggaaaccctcttcttccctggtctggctctgctggagcgggtgggaaccaaacaccttcagtgctggtggccctcaggcccacaggtttaaggctgaggctgccctgacccttccacagtcatttcttctaggttttcttggcccagcactgcccatcccaccccatgaggctcactcattgcagatcccagcccaccctgcccctttcttccccaccctggaggctctctctgcctagtctacagtactgacagaaagcaaggacatgcggcctgcatggtgggagctggttgaattgtctttattaacaaacaggatatccaaggccactacattgaggaggggtggggggggagggagaagggttacttgctgctcacactatatacagatgcaagcaaggggcgtggagagtgagggctccctgctccctccctccaccggggaagggcatgggctagaagaggagaggggggtcgggaatggggggaatgttttggctggcggggtcccccctccattccctggagtttgggggaaggggaatcattaaagtgctttcaga

SEQ ID NO: 5806 - DNA, 2262 bp, Homo sapiens
actgcagagagctgaggcaccatgcatgggggccaggggccgctgctcctcctgctgctgctggctgtctgcctgggggcccagggccggaaccaggaggagcgcctgctcgcagacctgatgcaaaactacgaccccaacctgcggcccgcggaacgagactcggatgtggtcaatgtcagcctgaagctaaccctcaccaacctcatctccctgaacgagcgagaggaagccctcaccaccaatgtctggatagagatgcagtggtgcgactatcgcctgcgctgggatccgcgagactacgaaggcctgtgggtgctgagggtgccgtccaccatggtgtggcggccggatatcgtgctggagaacaacgtggacggtgtcttcgaggtggccctctactgcaatgtgctcgtgtcccctgacggctgtatctactggctgccgcctgccatcttccgttccgcctgctctatctcagtcacctacttccccttcgactggcagaactgctcccttatcttccagtcccagacttacagcaccaatgagattgatctgcagctgagtcaggaagatggccagaccatcgagtggattttcattgaccctgaggccttcacagagaatggggagtgggccatccagcaccgaccagccaagatgctcctggacccagcggcgccagcccaggaagcaggccaccagaaggtggtgttctacctgctcatccagcgcaagcccctcttctacgtcatcaacatcatcgccccctgtgtgctcatctcctctgtcgccatcctcatccacttccttcctgccaaggctgggggccagaagtgtaccgtcgccatcaacgtgctcctggcccagactgtcttcctcttccttgtggccaagaaggtgcctgaaacctcccaggcggtgccactcatcagcaagtacctgaccttcctcctggtggtgaccatcctcattgtcgtgaatgctgtggttgtgctcaatgtctccttgcggtctccacacacacactccatggcccgaggggtccgcaaggtgttcctgaggctcttgccccagctgctgaggatgcacgttcgcccgctggccccggcagctgtgcaggacacccagtcccggctacagaatggctcctcgggatggtcgatcacaactggggaggaggtggccctctgcctgcctcgcagtgaactcctcttccagcagtggcagcggcaagggctggtggcggcagcgctggagaagctagagaaaggcccggagttagggctgagccagttctgtggcagcctgaagcaggctgccccagccatccaggcctgtgtggaagcctgcaacctcattgcctgtgcccggcaccagcagagtcactttgacaatgggaatgaggagtggttcctggtgggccgagtgctggaccgcgtctgcttcctggccatgctctcgctcttcatctgtggcacagctggcatcttcctcatggcccactacaaccgggtgccggccctgccattccctggagatccacgcccctacctgccctcaccagactgagccaaccaaccactgtggggcatgtgggagtcacacacgtgggtcacactgagtcttatcagccacgttctcctactgaggtcctaagtgtgctctttgggaagtgcccttcaggactgtgtgagccaaacagccctgagaaaagctggggaaacagtctgagctggagtccgagagtggttgggggtgggccgtggctagtgtcctgctgcagtcagcacacacgtgggattggctagctcatcctggcaccagccacccctccactcagtgcactcccctcacttaggcaaagcattattcattcccatcagtctgaagcccgaaggactgttttgtataataccttcggacttgggactggctccccttttacaagttctccctgaaagagggcagtcacaagaggtgtgaagagtagcagccgatgctctctccaaagcagggcagcagcccataccagctggcatctcccccccgtgccttctgggtacaataagcacccaattctcaacagccccagtggcctttccattcatgtgcatttttctgccactgaccacaagacgatttcctgagttttgtaatcctcttttttttttttttttttttagtttttgatgtgttgttgttgttttgtttagttttgagatagagcctcactcttgtcatgcaagttggagtgga

SEQ ID NO: 5807 - DNA, 2739 bp, Homo sapiens
actgcagagagctgaggcaccatgcatgggggccaggggccgctgctcctcctgctgctgctggctgtctgcctgggggcccagggccggaaccaggaggagcgcctgctcgcagacctgatgcaaaactacgaccccaacctgcggcccgcggaacgagactcggatgtggtcaatgtcagcctgaagctaaccctcaccaacctcatctccctgaacgagcgagaggaagccctcaccaccaatgtctggatagagatgcagtggtgcgactatcgcctgcgctgggatccgcgagactacgaaggcctgtgggtgctgagggtgccgtccaccatggtgtggcggccggatatcgtgctggagaacaacgtggacggtgtcttcgaggtggccctctactgcaatgtgctcgtgtcccctgacggctgtatctactggctgccgcctgccatcttccgttccgcctgctctatctcagtcacctacttccccttcgactggcagaactgctcccttatcttccagtcccagacttacagcaccaatgagattgatctgcagctgagtcaggaagatggccagaccatcgagtggattttcattgaccctgaggccttcacagagaatggggagtgggccatccagcaccgaccagccaagatgctcctggacccagcggcgccagcccaggaagcaggccaccagaaggtggtgttctacctgctcatccagcgcaagcccctcttctacgtcatcaacatcatcgccccctgtgtgctcatctcctctgtcgccatcctcatccacttccttcctgccaaggctgggggccagaagtgtaccgtcgccatcaacgtgctcctggcccagactgtcttcctcttccttgtggccaagaaggtgcctgaaacctcccaggcggtgccactcatcagcaagtacctgaccttcctcctggtggtgaccatcctcattgtcgtgaatgctgtggttgtgctcaatgtctccttgcggtctccacacacacactccatggcccgaggggtccgcaaggtgttcctgaggctcttgccccagctgctgaggatgcacgttcgcccgctggccccggcagctgtgcaggacacccagtcccggctacagaatggctcctcgggatggtcgatcacaactggggaggaggtggccctctgcctgcctcgcagtgaactcctcttccagcagtggcagcggcaagggctggtggcggcagcgctggagaagctagagaaaggcccggagttagggctgagccagttctgtggcagcctgaagcaggctgccccagccatccaggcctgtgtggaagcctgcaacctcattgcctgtgcccggcaccagcagagtcactttgacaatgggaatgaggagtggttcctggtgggccgagtgctggaccgcgtctgcttcctggccatgctctcgctcttcatctgtggcacagctggcatcttcctcatggcccactacaaccgggtgccggccctgccattccctggagatccacgcccctacctgccctcaccagactgagccaaccaaccactgtggggcatgtgggagtcacacacgtgggtcacactgagtcttatcagccacgttctcctactgaggtcctaagtgtgctctttgggaagtgcccttcaggactgtgtgagccaaacagccctgagaaaagctggggaaacagtctgagctggagtccgagagtggttgggggtgggccgtggctagtgtcctgctgcagtcagcacacacgtgggattggctagctcatcctggcaccagccacccctccactcagtgcactcccctcacttaggcaaagcattattcattcccatcagtctgaagcccgaaggactgttttgtataataccttcggacttgggactggctccccttttacaagttctccctgaaagagggcagtcacaagaggtgtgaagagtagcagccgatgctctctccaaagcagggcagcagcccataccagctggcatctcccccccgtgccttctgggtacaataagcacccaattctcaacagccccagtggcctttccattcatgtgcatttttctgccactgaccacaagacgatttcctgagttttgtaatcctcttttttttttttttttttttagtttttgatgtgttgttgttgttttgtttagttttgagatagagcctcactcttgtcatgcaagttggagtggagtgagctgtgatcatgtgactgcactccagcctgatgacacagtaagaccctgtctcaaaaaaaataaaaaaattacaaaactgaaaaaagaaaagtgaaagtgccacataaaggcctgacgacaggatatgctggcaggaggggaccttggaaatatgccctccctccaagcacaggattgctgtctttgggattcaatcaccagcaagttcgtattatttactccagtgtgagtctgtgtctgtgcatgcacagtgtgtttgaagcaagagcagagtcagagctatagagaactagaggagttagggagagtgggggagaacttcaatcagggagggaatctgatgacagtggggccatttccggttcccaccagccccttactagttgtgtatctggcacaagtctctcaacctctctgaaagcctcagagggcagaggattagctccttgtacacaataaacactcaaatgtt

SEQ ID NO: 5808 - DNA, 1739 bp, Homo sapiens
aaagagggcggcagacccgagcgcctaggactcgccgctgcccgcgccccgccgccgctgctgcccccagccccggccccaggcgtcccagccatggtccgcccaatgctcttgctcagcctcggcctcctggctggtctgctgccggcgctggccgcctgcccccagaactgccactgccacagcgacctgcagcacgtcatctgcgacaaggtggggctgcagaagatccccaaggtgtcagagaagaccaagctgctcaacctacagcgcaacaacttcccggtgctggctgccaattcgttccgggccatgccgaacctcgtgtcattgcacctgcagcactgccagatccgcgaggtggccgccggtgccttccgcggcctcaagcaacttatctacttgtacctgtcccataacgacatccgcgtgctgcgcgcaggtgccttcgacgacctgaccgagctgacctacctctacctggaccacaacaaggtcactgagctgccccgggggttgctctccccgctggtcaacctcttcatcttgcagctcaacaacaacaagatccgtgagctgcgcgcaggcgccttccagggagccaaggacctgcgctggctctacctgtcggaaaacgcgttgagctccctgcagcccggggccctggacgacgtggagaacctcgccaaattccacgtggacaggaaccagctgtccagctacccctcagctgccctgagcaagctacgggtggtggaggagctgaagctgtcccacaaccccctgaaaagcatcccggacaatgccttccagtcctttggcagatacctggagaccctctggctggacaacaccaacctggagaagttctcagatggtgccttcctgggtgtaaccacgctgaaacacgtccatttggagaacaaccgcttgaaccagctaccctccaacttccccttcgacagcctggagaccctcgcccttaccaataacccctggaagtgtacctgccagctccggggccttcggcggtggctggaagccaaggcctcccgcccagatgccacctgtgcctcacctgccaagttcaagggccagcacatccgtgacacggacgccttccgcagctgcaagttccccaccaagaggtccaagaaagctggccgccattaaacaggtgggggccaggttctgacccagccagtcctggtgactggcctctgccttccaccggagagactactgaccttctcacctccacccataccttctccccacagcctctgctgatgcacagagctgcctacacctagacacgtcctggcagggggcctcgggcactccactaccaacccagctccacccagcagtgtcctggggagaaggaaggctgagcctctccccagccttcatgccttccccaccctccagctcctcttggagaagctgttgctgagaccccccccccaagtcaatcagaaccacaacaggttggtcatcaggatggccaccctcccaggatcatccttcctctgttcctctttccctgccacgtggaaacaatcatcagatccttgccccaccccttgcttccagaaagggttttaaagcccatgccccaactctgccagcccccacctgccaggacgttctagcaggacatcggtgctttgctgtccatcttcccatgctgcaatttcttcctgagatttctataaatataaatgtatgtatgtatt

SEQ ID NO: 5809 - DNA, 594 bp, Homo sapiens
aggcctcccgcccagatgccacctgtgcctcacctgccaagttcaagggccagcacatccgtgacacggacgccttccgcagctgcaagttccccaccaagaggtccaagaaagctggccgccattaaacagcctctgctgatgcacagagctgcctacacctagacacgtcctggcagggggcctcgggcactccactaccaacccagctccacccagcagtgtcctggggagaaggaaggctgagcctctccccagccttcatgccttccccaccctccagctcctcttggagaagctgttgctgagaccccccccccaagtcaatcagaaccacaacaggttggtcatcaggatggccaccctcccaggatcatccttcctctgttcctctttccctgccacgtggaaacaatcatcagatccttgccccaccccttgcttccagaaagggttttaaagcccatgccccaactctgccagcccccacctgccaggacgttctagcaggacatcggtgctttgctgtccatcttcccatgctgcaatttcttcctgagatttctataaatataaatgtatgtatgtattata

SEQ ID NO: 5810 - DNA, 1789 bp, Homo sapiens
ggcctcgatgctccacgtaggagctggctcggctgccggctgcggtcagggccaccgtataaagagggcggcagacccgagcgcctaggactcgccgctgcccgcgccccgccgccgctgctgcccccagccccggccccaggcgtcccagccatggtccgcccaatgctcttgctcagcctcggcctcctggctggtctgctgccggcgctggccgcctgcccccagaactgccactgccacagcgacctgcagcacgtcatctgcgacaaggtggggctgcagaagatccccaaggtgtcagagaagaccaagctgctcaacctacagcgcaacaacttcccggtgctggctgccaattcgttccgggccatgccgaacctcgtgtcattgcacctgcagcactgccagatccgcgaggtggccgccggtgccttccgcggcctcaagcaacttatctacttgtacctgtcccataacgacatccgcgtgctgcgcgcaggtgccttcgacgacctgaccgagctgacctacctctacctggaccacaacaaggtcactgagctgccccgggggttgctctccccgctggtcaacctcttcatcttgcagctcaacaacaacaagatccgtgagctgcgcgcaggcgccttccagggagccaaggacctgcgctggctctacctgtcggaaaacgcgttgagctccctgcagcccggggccctggacgacgtggagaacctcgccaaattccacgtggacaggaaccagctgtccagctacccctcagctgccctgagcaagctacgggtggtggaggagctgaagctgtcccacaaccccctgaaaagcatcccggacaatgccttccagtcctttggcagatacctggagaccctctggctggacaacaccaacctggagaagttctcagatggtgccttcctgggtgtaaccacgctgaaacacgtccatttggagaacaaccgcttgaaccagctaccctccaacttccccttcgacagcctggagaccctcgcccttaccaataacccctggaagtgtacctgccagctccggggccttcggcggtggctggaagccaaggcctcccgcccagatgccacctgtgcctcacctgccaagttcaagggccagcacatccgtgacacggacgccttccgcagctgcaagttccccaccaagaggtccaagaaagctggccgccattaaacaggttctgacccagccagtcctggtgactggcctctgccttccaccggagagactactgaccttctcacctccacccataccttctccccacagcctctgctgatgcacagagctgcctacacctagacacgtcctggcagggggcctcgggcactccactaccaacccagctccacccagcagtgtcctggggagaaggaaggctgagcctctccccagccttcatgccttccccaccctccagctcctcttggagaagctgttgctgagaccccccccccaagtcaatcagaaccacaacaggttggtcatcaggatggccaccctcccaggatcatccttcctctgttcctctttccctgccacgtggaaacaatcatcagatccttgccccaccccttgcttccagaaagggttttaaagcccatgccccaactctgccagcccccacctgccaggacgttctagcaggacatcggtgctttgctgtccatcttcccatgctgcaatttcttcctgagatttctataaatataaatgtatgtatgtatta

SEQ ID NO: 5811 - DNA, 3013 bp, Homo sapiens
cggccgcggctgaggctccagtgccgagcgcaagaaccctgcgcagcccagagcagctgctggaggggaatcgaggcgcggctccggggattcggctcgggccgctggctctgctctgcggggagggagcgggcccgcccgcggggcccgagccctccggatccgccccctccccggtcccgccccctcggagactcctctggctgctctgggggttcgccggggccggggacccgcggtccgggcgccatgcgggcatcgctgctgctgtcggtgctgcggcccgcagggcccgtggccgtgggcatctccctgggcttcaccctgagcctgctcagcgtcacctgggtggaggagccgtgcggcccaggcccgccccaacctggagactctgagctgccgccgcgcggcaacaccaacgcggcgcgccggcccaactcggtgcagcccggagcggagcgcgagaagcccggggccggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctaggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccaggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactatgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgtccccgtgggccgtggcatggccacaccccaccccacttctcccccaaaaccagagccacctgccagcctcgctgggcagggctggccgtagccagaccccaagctggcccactggtcccctctctggctctgtgggtccctgggctctggacaagcactgggggacgtgcccccagagccacccacttctcatcccaaacccagtttccctgccccctgacgctgctgattcgggctgtggcctccacgtatttatgcagtacagtctgcctgacgccagccctgcctctgggccctgggggctgggctgtagaagagttgttggggaaggagggagctgaggagggggcatctcccaacttctcccttttggaccctgccgaagctccctgcctttaataaactggccaagtgtggacttgtga

SEQ ID NO: 5812 - DNA, 2210 bp, Homo sapiens
aacttccgatggccctgccttcccgagagccgtggggccagtccgagactttctctgggccctatcccggcctgggctgaacttactggactgtgtcctaaaccggctcgacccgatggcgccccagagatcctactagctccctggctgggctgctggtgttagagaaatgacttatatatagggacccgctacatcagcacggagctgggcatcaggcagaggctgctggtggcggtgctgacctctcagaccacgctgcccacgctgggcgtggccgtgaaccgcacgctggggcaccggctggagcgtgtggtgttcctgacgggcgcacggggccgccgggccccacctggcatggcagtggtgacgctaggcgaggagcgacccattggacacctgcacctggcgctgcgccacctgctggagcagcacggcgacgactttgactggttcttcctggtgcctgacaccacctacaccgaggcgcacggcctggcacgcctaactggccacctcagcctggcctccgccgcccacctgtacctgggccggccccaggacttcatcggcggagagcccacccccggccgctactgccacggaggctttggggtgctgctgtcgcgcatgctgctgcaacaactgcgcccccacctggaaggctgccgcaacgacatcgtcagtgcgcgccctgacgagtggctgggtcgctgcattctcgatgccaccggggtgggctgcactggtgaccacgagggggtgcactatagccatctggagctgagccctggggagccagtgcaggagggggaccctcatttccgaagtgccctgacagcccaccctgtgcgtgaccctgtgcacatgtaccagctgcacaaagctttcgcccgagctgaactggaacgcacgtaccaggagatccaggagttacagtgggagatccagaataccagccatctggccgttgatggggaccaggcagctgcttggcccgtgggtattccagcaccatcccgcccggcctcccgctttgaggtgctgcgctgggactacttcacggagcagcacgctttctcctgcgccgatggctcaccccgctgcccactgcgtggggctgaccgggctgatgtggccgatgttctggggacagctctagaggagctgaaccgccgctaccacccggccttgcggctccagaagcagcagctggtgaatggctaccgacgctttgatccggcccggggtatggaatacacgctggacttgcagctggaggcactgaccccccagggaggccgccggcccctcactcgccgagtgcagctgctccggccgctgagccgcgtggagatcttgcctgtgccctatgtcactgaggcctcacgtctcactgtgctgctgcctctagctgcggctgagcgtgacctggcccctggcttcttggaggcctttgccactgcagcactggagcctggtgatgctgcggcagccctgaccctgctgctactgtatgagccgcgccaggcccagcgcgtggcccatgcagatgtcttcgcacctgtcaaggcccacgtggcagagctggagcggcgtttccccggtgcccgggtgccatggctcagtgtgcagacagccgcaccctcaccactgcgcctcatggatctactctccaagaagcacccgctggacacactgttcctgctggccgggccagacacggtgctcacgcctgacttcctgaaccgctgccgcatgcatgccatctccggctggcaggccttctttcccatgcatttccaagccttccacccagctgtggccccaccacaagggcctgggcccccagagctgggccgtgacactggccgctttgatcgccaggcagccagcgaggcctgcttctacaactccgactatgtggcagcccgtgggcgcctggcggcagcctcagaacaagaagaggagctgctggagagcctggatgtgtacgagctgttcctccacttctccagtctgcatgtgctgcgggcggtggagccggcgctgctgcagcgctaccgggcccagacgtgcagcgcgaggctcagtgaggacctgtaccaccgctgcctccagagcgtgcttgagggcctcggctcccgaacccagctggccatgctactctttgaacaggagcagggcaacagcacctgaccccaccctgt

SEQ ID NO: 5813 - DNA, 3973 bp, Homo sapiens
aggggctgtgaggtggcagcggctgcagcggcggagccggcgcctcagcgggcactggggtctgttcccccttccccgtccctgctccctgccaggcgcgtgcgggacgccgctcttggtccccacgcctccgccccgccccctcccgggacgccgggagaccccggccgtcctttatccggtgtccgccggcccccggccctgaaacccgggcctcctccccgagggccttgggcgtccctcctggtcctgcgctcgcggcctcgatgctgtctctggcgcggcctccgctcccgccgactggcctgagaacgaggtctgtgccccagtctcccagccgcgacctccgaccccgcctcgcagaacgacccgagctggtctcccgagcccccttctcagcagcccggtgacgtggccagtttatttctgttttgagacgaacggcgaagactcgcgtcgggtcttcgttctagggctagacttggtctctgatcgccgagaggtagcgcaggggctgtgggcccccggcaggggtcctgtcggaagctggccgcgcttctgtttgcgttcccaggaccctggcattgtctctagttgctgcttgtgctctctctttgcttttggtttgcttcatttggcccctggggccctggtaaaaccaggcaccgaatcgctcgcacacagagttccagtccccgcctgctgtctcctcagcagctggggttccgaggagaatgccctgcaagatggctccatcggccatggcgctcctgagaggctgtcagtgctgagtcaccgatctacctcattcgggtgggcagaacttatgtgtgccatgcgagtggctccagaccgctcctgagtgggaggaggggttcctgtagccgttgcgtcttctcaaacacggggagcagagtagaaagaggctctggccccttcccttgtgcccaccgggcctgccgcagtggctcagcagccccttcagtagcccgcctgaggaccgatgccagaggcaggcattcttccggaaaggcccactgaggcaggctccggctcctctggttggggctgttgttttgatggatcgtgtgcttttcccttacctcttatcacttgctgtcatctgttgacttaggcccagtctgcagatgtgtgtagtgttcctttttgggttagctttggcagtattgagttttacttcctcctctttttagtggaagacagaccataatcccagtgtgagtgaaattgattgtttcatttattaccgttttggctgggggttagttccgacaccttcacagttgaagagcaggcagaaggagttgtgaagacaggacaatcttcttggggatgctggtcctggaagccagcgggcctcgctctgtctttggcctcattgaccccaggttctctggttaaaactgaaagcctactactggcctggtgcccatcaatccattgatccttgaggctgtgcccctggggcacccacctggcagggcctaccaccatgcgactgagctccctgttggctctgctgcggccagcgcttcccctcatcttagggctgtctctggggtgcagcctgagcctcctgcgggtttcctggatccagggggagggagaagatccctgtgtcgaggctgtaggggagcgaggagggccacagaatccagattccagagctcggctagaccaaagtgatgaagacttcaaaccccggattgtcccctactacagggaccccaacaagccctacaagaaggtgctcaggactcggtacatccagacagagctgggctcccgtgagcggttgctggtggctgtcctgacctcccgagctacactgtccactttggccgtggctgtgaaccgtacggtggcccatcacttccctcggttactctacttcactgggcagcggggggcccgggctccagcagggatgcaggtggtgtctcatggggatgagcggcccgcctggctcatgtcagagaccctgcgccaccttcacacacactttggggccgactacgactggttcttcatcatgcaggatgacacatatgtgcaggccccccgcctggcagcccttgctggccacctcagcatcaaccaagacctgtacttaggccgggcagaggagttcattggcgcaggcgagcaggcccggtactgtcatgggggctttggctacctgttgtcacggagtctcctgcttcgtctgcggccacatctggatggctgccgaggagacattctcagtgcccgtcctgacgagtggcttggacgctgcctcattgactctctgggcgtcggctgtgtctcacagcaccaggggcagcagtatcgctcatttgaactggccaaaaatagggaccctgagaaggaagggagctcggctttcctgagtgccttcgccgtgcaccctgtctccgaaggtaccctcatgtaccggctccacaaacgcttcagcgctctggagttggagcgggcttacagtgaaatagaacaactgcaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcctttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagcaccctgtggacactctcttcttccttaccaccgtgtggacaaggcctgggcccgaagtcctcaaccgctgtcgcatgaatgccatctctggctggcaggccttctttccagtccatttccaggagttcaatcctgccctgtcaccacagagatcacccccagggcccccgggggctggccctgaccccccctcccctcctggtgctgacccctcccggggggctcctataggggggagatttgaccggcaggcttctgcggagggctgcttctacaacgctgactacctggcggcccgagcccggctggcaggtgaactggcaggccaggaagaggaggaagccctggaggggctggaggtgatggatgttttcctccggttctcagggctccacctctttcgggccgtagagccagggctggtgcagaagttctccctgcgagactgcagcccacggctcagtgaagaactctaccaccgctgccgcctcagcaacctggaggggctagggggccgtgcccagctggctatggctctctttgagcaggagcaggccaatagcacttagcccgcctgggggccctaacctcattacctttcctttgtctgcctcagccccaggaagggcaaggcaagatggtggacagatagagaattgttgctgtattttttaaatatgaaaatgttattaaacatgtcttctgccaaa

SEQ ID NO: 5814 - DNA, 3517 bp, Homo sapiens
aggggctgtgaggtggcagcggctgcagcggcggagccggcgcctcagcgggcactggggtctgttcccccttccccgtccctgctccctgccaggcgcgtgcgggacgccgctcttggtccccacgcctccgccccgccccctcccgggacgccgggagaccccggccgtcctttatccggtgtccgccggcccccggccctgaaacccgggcctcctccccgagggccttgggcgtccctcctggtcctgcgctcgcggcctcgatgctgtctctggcgcggcctccgctcccgccgactggcctgagaacgaggtctgtgccccagtctcccagccgcgacctccgaccccgcctcgcagaacgacccgagctggtctcccgagcccccttctcagcagcccggtgacgtggccagtttatttctgttttgagacgaacggcgaagactcgcgtcgggtcttcgttctagggctagacttggtctctgatcgccgagaggtagcgcaggggctgtgggcccccggcaggggtcctgtcggaagctggccgcgcttctgtttgcgttcccaggaccctggcattgtctctagttgctgcttgtgctctctctttgcttttggtttgcttcatttggcccctggggccctggtaaaaccaggcaccgaatcgctcgcacacagagttccagtccccgcctgctgtctcctcagcagctggggttccgaggagaatgccctgcaagatggctccatcggccatggcgctcctgagaggctgtcagtgctgagtcaccgatctacctcattcgggtgggcagaacttatgtgtgccatgcgagtggctccagaccgctcctgagtgggaggaggggttcctgtagccgttgcgtcttctcaaacacggggagcagagtagaaagaggctctggccccttcccttgtgcccaccgggcctgccgcagtggctcagcagccccttcagtagcccgcctgaggaccgatgccagaggcaggcattcttccggaaaggcccactgaggcaggctccggctcctctggttggggctgttgttttgatggatcgtgtgcttttcccttacctcttatcacttgctgtcatctgttgacttaggcccagtctgcagatgtgtgtagtgttcctttttgggttagctttggcagtattgagttttacttcctcctctttttagtggaagacagaccataatcccagtgtgagtgaaattgattgtttcatttattaccgttttggctgggggttagttccgacaccttcacagttgaagagcaggcagaaggagttgtgaagacaggacaatcttcttggggatgctggtcctggaagccagcgggcctcgctctgtctttggcctcattgaccccaggttctctggttaaaactgaaagcctactactggcctggtgcccatcaatccattgatccttgaggctgtgcccctggggcacccacctggcagggcctaccaccatgcgactgagctccctgttggctctgctgcggccagcgcttcccctcatcttagggctgtctctggggtgcagcctgagcctcctgcgggtttcctggatccagggggagggagaagatccctgtgtcgaggctgtaggggagcgaggagggccacagaatccagattccagagctcggctagaccaaagtgatgaagacttcaaaccccggattgtcccctactacagggaccccaacaagccctacaagaaggtgctcaggactcggtacatccagacagagctgggctcccgtgagcggttgctggtggctgtcctgacctcccgagctacactgtccactttggccgtggctgtgaaccgtacggtggcccatcacttccctcggttactctacttcactgggcagcggggggcccgggctccagcagggatgcaggtggtgtctcatggggatgagcggcccgcctggctcatgtcagagaccctgcgccaccttcacacacactttggggccgactacgactggttcttcatcatgcaggatgacacatatgtgcaggccccccgcctggcagcccttgctggccacctcagcatcaaccaagacctgtacttaggccgggcagaggagttcattggcgcaggcgagcaggcccggtactgtcatgggggctttggctacctgttgtcacggagtctcctgcttcgtctgcggccacatctggatggctgccgaggagacattctcagtgcccgtcctgacgagtggcttggacgctgcctcattgactctctgggcgtcggctgtgtctcacagcaccaggggcagcagtatcgctcatttgaactggccaaaaatagggaccctgagaaggaagggagctcggctttcctgagtgccttcgccgtgcaccctgtctccgaaggtaccctcatgtaccggctccacaaacgcttcagcgctctggagttggagcgggcttacagtgaaatagaacaactgcaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcctttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagcaccctgtggacactctcttcttccttaccaccgtgtggacaaggcctgggcccgaagtcctcaaccgctgtcgcatgaatgccatctctggctggcaggccttctttccagtccatttccaggagttcaatcctgccctgtcaccacagagatcacccccacctaacctcattacctttcctttgtctgcctcagccccaggaagggcaaggcaagatggtggacagatagagaattgttgctgtattttttaa

SEQ ID NO: 5815 - DNA, 8290 bp, Homo sapiens
gcgcccaggagcagagccgcgctcgctccactcagctcccagctcccaggactccgctggctcctcgcaagtcctgccgcccagcccgccgggatgcagtccgggccgcggcccccacttccagcccccggcctggccttggctttgaccctgactatgttggccagacttgcatccgcggcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctagagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggacattatgaagctttctccaccctggcccctgaggcttggccagccatggagctgcctgagccatgcgtgcctgagccagggctgcctcctgtctttgccaatttcacccagctgctgactatcagcccactggtggtggccgaggggggcacagcctggcttgagtggaggcatgtgcagcccacgctggacctgatggaggctgagctgcgcaaatcccaggtgctgttcagcgtgacccgaggggcacgccatggcgagctcgagctggacatcccgggagcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccaccgcggtggtcctgcacaggacttgacgttccgggtcagcgatggactgcaggccagccccccggccacgctgaaggtggtggccatccggccggccatacagatccaccgcagcacagggttgcgactggcccaaggctctgccatgcccatcttgcccgccaacctgtcggtggagaccaatgccgtggggcaggatgtgagcgtgctgttccgcgtcactggggccctgcagtttggggagctgcagaagcagggggcaggtggggtggagggtgctgagtggtgggccacacaggcgttccaccagcgggatgtggagcagggccgcgtgaggtacctgagcactgacccacagcaccacgcttacgacaccgtggagaacctggccctggaggtgcaggtgggccaggagatcctgagcaatctgtccttcccagtgaccatccagagagccactgtgtggatgctgcggctggagccactgcacactcagaacacccagcaggagaccctcaccacagcccacctggaggccaccctggaggaggcaggcccaagccccccaaccttccattatgaggtggttcaggctcccaggaaaggcaaccttcaactacagggcacaaggctgtcagatggccagggcttcacccaggatgacatacaggctggccgggtgacctatggggccacagcacgtgcctcagaggcagtcgaggacaccttccgtttccgtgtcacagctccaccatatttctccccactctataccttccccatccacattggtggtgacccagatgcgcctgtcctcaccaatgtcctcctcgtggtgcctgagggtggtgagggtgtcctctctgctgaccacctctttgtcaagagtctcaacagtgccagctacctctatgaggtcatggagcggccccgccatgggaggttggcttggcgtgggacacaggacaagaccactatggtgacatccttcaccaatgaagacctgttgcgtggccggctggtctaccagcatgatgactccgagaccacagaagatgatatcccatttgttgctacccgccagggcgagagcagtggtgacatggcctgggaggaggtacggggtgtcttccgagtggccatccagcccgtgaatgaccacgcccctgtgcagaccatcagccggatcttccatgtggcccggggtgggcggcggctgctgactacagacgacgtggccttcagcgatgctgactcgggctttgctgacgcccagctggtgcttacccgcaaggacctcctctttggcagtatcgtggccgtagatgagcccacgcggcccatctaccgcttcacccaggaggacctcaggaagaggcgagtactgttcgtgcactcaggggctgaccgtggctggatccagctgcaggtgtccgacgggcaacaccaggccactgcgctgctggaggtgcaggcctcggaaccctacctccgtgtggccaacggctccagccttgtggtccctcaaggaggccagggcaccatcgacacggccgtgctccacctggacaccaacctcgacatccgcagtggggatgaggtccactaccacgtcacagctggccctcgctggggacagctagtccgggctggtcagccagccacagccttctcccagcaggacctgctggatggggccgttctctatagccacaatggcagcctcagcccccgcgacaccatggccttctccgtggaagcagggccagtgcacacggatgccaccctacaagtgaccattgccctagagggcccactggccccactgaagctggtccggcacaagaagatctacgtcttccagggagaggcagctgagatcagaagggaccagctggaggcagcccaggaggcagtgccacctgcagacatcgtattctcagtgaagagcccaccgagtgccggctacctggtgatggtgtcgcgtggcgccttggcagatgagccacccagcctggaccctgtgcagagcttctcccaggaggcagtggacacaggcagggtcctgtacctgcactcccgccctgaggcctggagcgatgccttctcgctggatgtggcctcaggcctgggtgctcccctcgagggcgtccttgtggagctggaggtgctgcccgctgccatcccactagaggcgcaaaacttcagcgtccctgagggtggcagcctcaccctggcccctccactgctccgtgtctccgggccctacttccccactctcctgggcctcagcctgcaggtgctggagccaccccagcatggagccctgcagaaggaggacggacctcaagccaggaccctcagcgccttctcctggagaatggtggaagagcagctgatccgctacgtgcatgacgggagcgagacactgacagacagttttgtcctgatggctaatgcctccgagatggatcgccagagccatcctgtggccttcactgtcactgtcctgcctgtcaatgaccaaccccccatcctcactacaaacacaggcctgcagatgtgggagggggccactgcgcccatccctgcggaggctctgaggagcacggacggcgactctgggtctgaggatctggtctacaccatcgagcagcccagcaacgggcgggtagtgctgcggggggcgccgggcactgaggtgcgcagcttcacgcaggcccagctggacggcgggctcgtgctgttctcacacagaggaaccctggatggaggcttccgcttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccggggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcctggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttccactccaacccaggccaccctttgtctctgccccagagttgagaaaaaaacttcctcccctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggttaggctggggctcatcgagggtctcaggccgaggccactgcggtgccagtgcccccctgaggactagggcaggcagctgggggcacttggttccatggagcctggataaacagtgctttggaggctctggacagctgtgtggtgtttgtgtcttaactatgcactgggcccttgtctgcgtcggcttgcatacagagggcccctggggtcggccctccggcctggcctcagccagtgggatggacagggccaggcaggcctctgaacttccacctcctggggcctcccagacctcctgtgcccccacctgtgtgggcaggtgggccagtcttcgggtgatgggaccaaaccccttcagttcagtagagaaaggctaggtcctctacaaagagctgcaagacaaaaattaaaataaatgctccccaccctaga

SEQ ID NO: 5816 - DNA, 981 bp, Homo sapiens
gagcagcatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccct

SEQ ID NO: 5817 - DNA, 4550 bp, Homo sapiens
ggcgagctaagccggaggatgtgcagctgcggcggcggcgccggctacgaagaggacggggacaggcgccgtgcgaaccgagcccagccagccggaggacgcgggcagggcgggacgggagcccggactcgtctgccgccgccgtcgtcgccgtcgtgccggccccgcgtccccgcgcgcgagcgggaggagccgccgccacctcgcgcccgagccgccgctagcgcgcgccgggcatggtcccctcttaaaggcgcaggccgcggcggcgggggcgggcgtgcggaacaaagcgccggcgcggggcctgcgggcggctcgggggccgcgatgggcgcggcgggcccgcggcggcggcggcgctgcccgggccgggcctcgcggcgctagggcgggctggcctccgcgggcgggggcagcgggctgagggcgcgcggagcctgcggcggcggcccggcgggcggagcggcgcgggcatggccgcgcgcggccggcgcgcctggctcagcgtgctgctcgggctcgtcctgggcttcgtgctggcctcgcggctcgtcctgccccgggcttccgagctgaagcgagcgggcccacggcgccgcgccagccccgagggctgccggtccgggcaggcggcggcttcccaggccggcggggcgcgcggcgatgcgcgcggggcgcagctctggccgcccggctcggacccagatggcggcccgcgcgacaggaactttctcttcgtgggagtcatgaccgcccagaaatacctgcagactcgggccgtggccgcctacagaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtgtttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacccagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgttttttttttttacaattgttttaaagccatttcatgttccagttgtaagataaggaaatgtgataatagctgtttcatcattgtcttcaggagagctttccagagttgatcatttcctctcatggtactctgctcagcatggccacgtaggttttttgtttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagctagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacatacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgtacttttcgaaccattttgtctcattattcctgttttagctgaagaattgtattacatttggagagtaaaaaacttaaacacgattca

SEQ ID NO: 5818 - DNA, 3850 bp, Homo sapiens
gggtggcagcctaggagcggacgcgttgccgccgccgctgctcctcctcctcctcctgcagctcctccagctgccgctgctgccgccgctgccgccaccgccgccgccgggagaagtttcactcccgacccttgctcggagccccggcccagagctgagcgggagcccggcaggcagctgcagcccgcggcagtcgaggcgtccgcggcgcttcgacctccagccggtgtcggcgcctaggcggccggctgcggccgcggctgggggcgcaaaggcggaggaggggcgggtgtgagccggggaaaccgcgtgccgcgccgcgacagcccagcgagcgtccgcgcccgggacagccgcgatggctgtgcgctctcgccgcccgtggatgagcgtggcattagggctggtgctgggcttcaccgccgcgtcctggctcatcgcccccagggtggcggagctgagcgagaggaagagacgtggctccagcctctgctcctactacggtcgctctgctgctggcccccgcgccggcgctcagcagccgctcccccagccccagtcccgaccacggcaggagcagtcgccgccccccgcgcgccaggatctccaggggccaccgctgcccgaggcagcacccgggatcaccagttttcgaagcagcccctggcagcagccacctccgctgcagcagcggcggcgaggacgcgagcctgagggcgcgacggggcttcccggtgctccagcggccgagggggagcccgaggaggaggacgggggcgcggctgggcagcggagagacggccggccggggagtagccacaacggcagcggggacgggggcgctgccgccccgagcgcccgaccccgggacttcctgtacgtgggggtgatgaccgcgcagaagtacctgggcagccgcgcgctggccgcgcagcggacctgggcgcgtttcatcccgggccgcgtggagttcttttccagccagcagccccccaacgccggccagcccccgccacccctgcctgtcatcgcgctaccgggtgtggacgactcctatcctccccagaaaaagtccttcatgatgatcaagtacatgcacgaccactacctggacaagtatgagtggttcatgcgcgccgacgacgatgtctacatcaaaggtgataaattagaagagtttcttagatcgctaaacagcagtaagcctctctacctgggacagactggcctggggaatattgaagagcttggaaagctgggactggagcctggggaaaacttctgtatgggaggacctggcatgatctttagccgagaagttctcaggaggatggtgccacatattggtgaatgccttagagaaatgtacacgactcatgaggatgtggaagtaggaagatgcgttcgccgttttggtgggactcagtgtgtctggtcttacgagatgcaacaactgttccatgaaaattatgaacacaatcggaagggttacatccaagaccttcacaatagcaaaatccatgcagccataacacttcatcccaacaaaaggcctgcataccaatacaggctgcataattacatgctcagccgcaaaatttctgaacttcgctaccgcaccatccagctccacagggaaagtgccctgatgagcaagctcagtaacacagaagtgagcaaagaggaccagcagctgggagtgataccttctttcaaccacttccagcctcgggagagaaatgaagtgatagaatgggagttcctgacagggaagcttctatactcagcagctgagaaccagccccctcgacagagcctcagtagcattttaagaacagcactggatgataccgtcctacaggtgatggagatgatcaatgagaatgccaagagcagaggacggctcattgacttcaaggaaattcagtatggctaccgcagagttaaccccatgcacggggtggagtacattttggatttactccttttatacaaaagacacaagggaaggaaactgactgtgccagtgagacgtcatgcctatcttcagcagttgttcagcaagcctttcttcagagagaccgaagagctagatgtcaacagtcttgtggagagtattaacagtgaaactcagtcattctcctttatatctaattctttaaagatattatcttcttttcaaggtgccaaagaaatgggagggcacaatgaaaagaaagtacacattctcgttcctctcatcggaaggtatgacattttcttgagattcatggagaactttgaaaacatgtgtcttatcccaaagcagaatgtaaagttggtcattatccttttcagtagggattctggccaagactccagcaagcatattgagctgataaaagggtaccagaacaagtaccccaaagcagaaatgaccctgatcccaatgaagggagagttttccagaggtcttggtcttgaaatggcttctgcccagtttgacaatgacactttgctgctattttgtgatgttgacttgatcttcagagaagattttctccaacgatgtagagacaatacaattcagggacaacaggtgtactatcccatcatctttagccagtatgacccaaaggtaacaaacgggggaaatcctcccactgatgattacttcatattctcaaaaaagactggattttggagagactatggatatggcatcacctgtatttacaaaagtgatcttctaggtgcaggtggatttgatacctcaatacaaggctggggactagaagatgtagatctctacaataaagtcattctatctggcttaaggccattcagaagccaagaagtaggagtggtgcatattttccatccagttcattgtgatcctaacttggaccctaagcagtataagatgtgcttaggatccaaggcaagtactttcgcctcaaccatgcaactggctgaactctggcttgaaaaacatttaggtgtcaggtacaatcgaactctctcctgacagtccaggcaacacattttgccttttttaaggggagtttacctcattgttggttgttgttatttttattgtattattgttattttattattattattgttataattttattttgttgtcctggtcttaaactactcttggttgtcttcctaagggtgtttgttgacctcaagcaagaagagtctgcagttcactgatgtttcagatttctactgaagtcaatatgttattacttttatataactttatttgagattgagttaaatcatagcaatcaaatgacttttgaaacgcattcatcacaagagacagcttagaagaatgttctcttggggcttaaagatgcaatatcgacttttatttggtttctcaaattcaatgtgatacaaatatttactggtgaaaggtaccacaaaagtgctttatgcttcctatggggaagggactctgtaacataaacttgagttttgtaatttatacaaggacttaaatatataaacaataattttcttcatctttagaatttttaaagtaaatgaatacctatgattgtatgtttattttttaaaaaaagttttaaaaattgaggagttttgttccacaagcaaccggtactggctaccctggtcttatgacaattatgagctcctcacaactgtctgctataaatgcgaatgaactttattttctcaaggaaatatgatttaattaaatattcatgtacattttagaagctttatgaaacaatgtccttcatttgctggcaagaagataaaatatgacagaacctgtttatttaaaataaaacacaggtatagcagtattctttttcaaaaacactga

SEQ ID NO: 5819 - DNA, 3521 bp, Homo sapiens
cccgggtcagcgcccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggactaacccaggttcccttgaggctccagattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtc

SEQ ID NO: 5820 - DNA, 531 bp, Homo sapiens
cccgggtcagcgcccgcccgcccgcgctcctcccggccgctcctcccgccccgcccggcccggcgccgactctgcggccgcccgacgagcccctcgcggcactgccccggccccggccccggccccggccccctcccgccgcaccgcccccggcccggccctccgccctccgcactcccgcctccctccctccgcccgctcccgcgccctcctccctccctcctccccagctgtcccgttcgcgtcatgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgacagggaccttgaggcccagagagatgaagtag

SEQ ID NO: 5821 - DNA, 2310 bp, Homo sapiens
ggagagcacctgtctcagaaaggcccacatgtgcggccttgcaggactaacccaggttcccttgaggctccagattctacaccaggggcagctactgcgagaacttcaggccaatgtctcagcccaggtgagtggggatctggctctcgctgccacctgtcttggcctcttgctattgcccatcacaccctgctctgtccccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtc

SEQ ID NO: 5822 - DNA, 3155 bp, Homo sapiens
atgccgagcctcccggccccgccggccccgctgctgctcctcgggctgctgctgctcggctcccggccggcccgcggcgccggcccagagccccccgtgctgcccatccgttctgagaaggagccgctgcccgttcggggagcggcaggctgcaccttcggcgggaaggtctatgccttggacgagacgtggcacccggacctaggggagccattcggggtgatgcgctgcgtgctgtgcgcctgcgaggcgcctcagtggggtcgccgtaccaggggccctggcagggtcagctgcaagaacatcaaaccagagtgcccaaccccggcctgtgggcagccgcgccagctgccgggacactgctgccagacctgcccccaggagcgcagcagttcggagcggcagccgagcggcctgtccttcgagtatccgcgggacccggagcatcgcagttatagcgaccgcggggagccaggcgctgaggagcgggcccgtggtgacggccacacggacttcgtggcgctgctgacagggccgaggtcgcaggcggtggcacgagcccgagtctcgctgctgcgctctagcctccgcttctctatctcctacaggcggctggaccgccctaccaggatccgcttctcagactccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggactaacccaggttcccttgaggctccagattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcaggtgcacatagccaaccaatgtgaggttggcggactgcgcctggaggcggccggggccgagggggtgcgggcgctgggggctccggatacagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtc

SEQ ID NO: 5823 - DNA, 2536 bp, Homo sapiens
tcttaagcttcctagggcaccctggaggttcctttccatgttcctttttcataagccctgcctgggcatcctaattggcctagcctgcacagtgtctgagcgtagggccttcttgtctctctgctccaggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggtaagtgggatgggggcaaaacacgtgagaaggttagggagagcacctgtctcagaaaggcccacatgtgcggccttgcaggactaacccaggttcccttgaggctccagattctacaccaggggcagctactgcgagaacttcaggccaatgtctcagcccaggtgagtggggatctggctctcgctgccacctgtcttggcctcttgctattgcccatcacaccctgctctgtccccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggtgcaagtggtagggacaagcagtgaggtggtggccatgacactggagaccaagcctcagcggagggatcagcgcactgtcctgtgccacatggctggactccagccaggaggacacacggccgtgggtatctgccctgggctgggtgcccgaggggctcatatgctgctgcagaatgagctcttcctgaacgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgatgatcaccaccaagggtagccccagaggggagctccgagggcagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccttttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcc

SEQ ID NO: 5824 - DNA, 3935 bp, Homo sapiens
actctagctctcgccacaacctgccagccccagacctcggacgagagcgccccggggagctcggagcgcgtgcacgcgtggcagacggagaaggccagtgcccaggttagtgagcagtgcccggcgcccgcttccctcacctccttttccagcctttgcacagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctccctctctcacagacacacacacacacacacacacacacacacacacgcacgtccacactcacattaaacgaaagctttatttgaagcaaagctagccaagattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaatagatcagtactcactaatatttttgagaccatagttgtctggtcagaaaaattatattaaattagtaaattctagaagctctttaaaagggaagttttccttcttctccaattataggagttgatttttactttgcaaagtggctcggtcctcatgagcatctgcatgttgactcttcagttaagaaaattgttgttcatttagggaggtggatattctgatgaagatctttatcctaaaccttcctactatccttgtcttattcatcaagcagatattttagtcaagaattccagagaaggctgctcctaaaatgtctacttgcagcccaataccagagcataaactatccattctggggtctggctttagaaatcatctttgtgggaagacctaattcttcacagcaaggatctcaggcatgccttctagatttgttccctctgaggggcaggaatgaactgtagaaatgttttaaggacccagaaaccccatatgtctcattccatgactataggtgagagaattctttcctaagagggtttgataccaataggggaaaatgtaaaatgttcagtctttatgacaacctggcataaaggagtcaattcttatgaaagagacacaagggccttatggccagggtttcttgggacaagactctcaccagcacatcacacacgttctccttggaagagagaagcagtacatcccggttgagaggtcacaaagcattagtttgtgtgtgtgtgtgtgtgtgtgtgtgtgtgtgtgtgtgtgtgtgtgtggtaaaggggggaaggtgttatgcggctgctccctccgtcccagaggtggcagtgattccataatgtggagactagtaactagatcctaaggcaaagaggtgtttctccttctggatgattcatcccaaagccttcccacccaggtgttctctgaaagcttagccttaagagaacacgcagagagtttccctagatatactcctgcctccaggtgctgggacacacctttgcaaaatgctgtgggaagcaggagctggggagctgtgttaagtcaaagtagaaaccctccagtgtttggtgttgtgtagagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaattttg

SEQ ID NO: 5825 - DNA, 1934 bp, Homo sapiens
cggacgagagcgccccggggagctcggagcgcgtgcacgcgtggcagacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccat

SEQ ID NO: 5826 - DNA, 3860 bp, Homo sapiens
gacggagaaggccagtgcccaggttagtgagcagtgcccggcgcccgcttccctcacctccttttccagcctttgcacagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctccctctctcacagacacacacacacacacacacacacacacacacacgcacgtccacactcacattaaacgaaagctttatttgaagcaaagctagccaagattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaatagatcagtactcactaatatttttgagaccatagttgtctggtcagaaaaattatattaaattagtaaattctagaagctctttaaaagggaagttttccttcttctccaattataggagttgatttttactttgcaaagtggctcggtcctcatgagcatctgcatgttgactcttcagttaagaaaattgttgttcatttagggaggtggatattctgatgaagatctttatcctaaaccttcctactatccttgtcttattcatcaagcagatattttagtcaagaattccagagaaggctgctcctaaaatgtctacttgcagcccaataccagagcataaactatccattctggggtctggctttagaaatcatctttgtgggaagacctaattcttcacagcaaggatctcaggcatgccttctagatttgttccctctgaggggcaggaatgaactgtagaaatgttttaaggacccagaaaccccatatgtctcattccatgactataggtgagagaattctttcctaagagggtttgataccaataggggaaaatgtaaaatgttcagtctttatgacaacctggcataaaggagtcaattcttatgaaagagacacaagggccttatggccagggtttcttgggacaagactctcaccagcacatcacacacgttctccttggaagagagaagcagtacatcccggttgagaggtcacaaagcattagtttgtgtgtgtgtgtgtgtgtgtgtgtgtgtgtgtgtgtgtgtgtgtgtggtaaaggggggaaggtgttatgcggctgctccctccgtcccagaggtggcagtgattccataatgtggagactagtaactagatcctaaggcaaagaggtgtttctccttctggatgattcatcccaaagccttcccacccaggtgttctctgaaagcttagccttaagagaacacgcagagagtttccctagatatactcctgcctccaggtgctgggacacacctttgcaaaatgctgtgggaagcaggagctggggagctgtgttaagtcaaagtagaaaccctccagtgtttggtgttgtgtagagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaattttgaaaaatca

SEQ ID NO: 5827 - DNA, 2413 bp, Homo sapiens
gacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctccctctctcacagacacacacacacacacacacacacacacacacacgcacgtccacactcacattaaacgaaagctttatttgaagcaaagctagccaagattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaata

SEQ ID NO: 5828 - DNA, 3850 bp, Homo sapiens
gtgcttgcggacttcccgccagcgccgagcggccggcttctcgggccaagtggggagcgagcgggagggcgggcaggtggccccgggccgccgcgcccgcgccttggctctgcccccgggagccgagcaagccgctgctccctcgtggtgtgagggcggtgatgtttttcctcccacccacttttgagttccccctcccccctcgcgcgcactctagctctcgccacaacctgccagccccagacctcggacgagagcgccccggggagctcggagcgcgtgcacgcgtggcagacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctccctctctcacagacacacacacacacacacacacacacacacacacgcacgtccacactcacattaaacgaaagctttatttgaagcaaagctagccaagattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaatagatcagtactcactaatatttttgagaccatagttgtctggtcagaaaaattatattaaattagtaaattctagaagctctttaaaagggaagttttccttcttctccaattataggagttgatttttactttgcaaagtggctcggtcctcatgagcatctgcatgttgactcttcagttaagaaaattgttgttcatttagggaggtggatattctgatgaagatctttatcctaaaccttcctactatccttgtcttattcatcaagcagatattttagtcaagaattccagagaaggctgctcctaaaatgtctacttgcagcccaataccagagcataaactatccattctggggtctggctttagaaatcatctttgtgggaagacctaattcttcacagcaaggatctcaggcatgccttctagatttgttccctctgaggggcaggaatgaactgtagaaatgttttaaggacccagaaaccccatatgtctcattccatgactataggtgagagaattctttcctaagagggtttgataccaataggggaaaatgtaaaatgttcagtctttatgacaacctggcataaaggagtcaattcttatgaaagagacacaagggccttatggccagggtttcttgggacaagactctcaccagcacatcacacacgttctccttggaagagagaagcagtacatcccggttgagaggtcacaaagcattagtttgtgtgtgtgtgtgtgtgtgtgtgtgtgtgtgtgtgtgtgtgtgtgtggtaaaggggggaaggtgttatgcggctgctccctccgtcccagaggtggcagtgattccataatgtggagactagtaactagatcctaaggcaaagaggtgtttctccttctggatgattcatcccaaagccttcccacccaggtgttctctgaaagcttagccttaagagaacacgcagagagtttccctagatatactcctgcctccaggtgctgggacacacctttgcaaaatgctgtgggaagcaggagctggggagctgtgttaagtcaaagtagaaaccctccagtgtttggtgttgtgtagagaataggacatagggtaaagaggccaagctgcctgtagttagtagagaagaatggatgtggttcttcttgtgtatttatttgtatcataaacacttggaacaacaaagaccataagcatcatttagcagttgtagccattttctagttaactcatgtaaacaagtaagagtaacataacagtattaccctttcactgttctcacaggacatgtacctaattatggtacttatttatgtagtcactgtatttctggatttttaaattaataaaaaagttaattttg

SEQ ID NO: 5829 - DNA, 1658 bp, Homo sapiens
ccagacctcggacgagagcgccccggggagctcggagcgcgtgcacgcgtggcagacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggagggaaacgtgtattgtggtctcaagacttgccccaaattaacctgtgccttcccagtctctgttccagattcctgctgccgggtatgcagaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagccct

SEQ ID NO: 5830 - DNA, 1537 bp, Homo sapiens
ccagacctcggacgagagcgccccggggagctcggagcgcgtgcacgcgtggcagacggagaaggccagtgcccagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccaggagatggagaactgtcatgggaacattctgatggtgatatcttccggcaacctgccaacagagaagcaagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggcattctccagcacttccatattgagaagatctccaagaggatgtttgaggagcttcctcacttcaagctggtgaccagaacaaccctgagccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaa

SEQ ID NO: 5831 - DNA, 1712 bp, Homo sapiens
ccctttctttgatcgcctctcccttctgctggaccttccttcgtctctccatctctccctcctttccccgcgttctctttccacctttctcttcttcccaccttagacctcccttcctgccctcctttcctgcccaccgctgcttcctggcccttctccgaccccgctctagcagcagacctcctggggtctgtgggttgatctgtggcccctgtgcctccgtgtccttttcgtctcccttcctcccgactccgctcccggaccagcggcctgaccctggggaaaggatggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaagatgaggaaactgaggctcagagaggtgaagtacctggcccaaggccacacagccagaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataacaaagacctaacagttgcagatatgagctgtataattgttgttattatatattaataaataagaagttgcattaccctca

SEQ ID NO: 5832 - DNA, 1028 bp, Homo sapiens
cagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagctggctccagctggggcctgctatgctcagtcagtgactttcatccttcctgccatttgcagagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaaggtgtcttcctagcccagaccctggagctgaaggtcacggccagtccagacaaagtgaccaagacataacaaagacctaacagttgcagatatgagctgtataattgttgttattatatattaataaataagaagttgcattaccctca

SEQ ID NO: 5833 - DNA, 1867 bp, Homo sapiens
gccgccgcgccgccgccgctgctgggaccgccgccccgccgggccccaggcccccgcggcccgaccccgagcccaccgagcagggggcgccggccgcctctagcccgcgcgcccgcaacacccgctggtcccgcgcgcctcgcccggcgctgcgcgctcggcagacgccggtcctctccctgctttctcctcctctccctctcaccttccccctttctttgatcgcctctcccttctgctggaccttccttcgtctctccatctctccctcctttccccgcgttctctttccacctttctcttcttcccaccttagacctcccttcctgccctcctttcctgcccaccgctgcttcctggcccttctccgaccccgctctagcagcagacctcctggggtctgtgggttgatctgtggcccctgtgcctccgtgtccttttcgtctcccttcctcccgactccgctcccggaccagcggcctgaccctggggaaaggatggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaaggaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataacaaagacctaacagttgcagatatgagctgtataattgttgttattatatattaataaataagaagttgcattaccctca

SEQ ID NO: 5834 - DNA, 1462 bp, Homo sapiens
cgcctctcccttctgctggaccttccttcgtctctccatctctccctcctttccccgcgttctctttccacctttctcttcttcccaccttagacctcccttcctgccctcctttcctgcccaccgctgcttcctggcccttctccgaccccgctctagcagcagacctcctggggtctgtgggttgatctgtggcccctgtgcctccgtgtccttttcgtctcccttcctcccgactccgctcccggaccagcggcctgaccctggggaaaggatggttcccgaggtgagggtcctctcctccttgctgggactcgcgctgctctggttccccctggactcccacgctcgagcccgcccagacatgttctgccttttccatgggaagagatactcccccggcgagagctggcacccctacttggagccacaaggcctgatgtactgcctgcgctgtacctgctcagagggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaagacgtcttcctagcccagaccctggagctgaaggtcacggccagtccagacaaagtgaccaagacataa

SEQ ID NO: 5835 - DNA, 917 bp, Homo sapiens
tgcaggaaagcctcaagtagaggagggttgaggcttcagtccagcacctttctcgggtcacggcctcctcctggctcccaggaccccaccataggcagaggcaggccttcctacaccctactccctgtgcctccagcctcgactagtccctagcactcgacgactgagtctctgaggtcacttcaccgtggtctccgcctcacccttggcgctggaccagtgagaggagagggctggggcgctccgctgagccactcctgcgcccccctggccttgtctacctcttgccccccgaggggttagtgtcgagctcaccccagcatcctatcacctcctggtggccttgccgcccccacaaccccgaggtataaagccaggtacacgaggcaggggacgcaccaaggatggagatgttccaggggctgctgctgttgctgctgctgagcatgggcgggacatgggcatccaaggagccgcttcggccacggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgcccgcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagcccatcccgactcccggggccctcggacaccccgatcctcccacaataaaggcttctcaatccg

SEQ ID NO: 5836 - DNA, 917 bp, Homo sapiens; identical to SEQ ID NO: 5835

SEQ ID NO: 5837 - DNA, 900 bp, Homo sapiens
atgtacacagaaacaggtggggtcaagcagggagagagaactggccagggtataaaaagggcccacaagagaccggctctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttcccttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtatca

SEQ ID NO: 5838 - DNA, 1073 bp, Homo sapiens
accggctctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttcccttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcgccaggggtcaccaatcctggaaccccactggcttcgagggctgggggagagaaatactgctgccctctttttagcagtaaggcgctgacccaagagaactcaccttattcttcatttcgcctggtgaatcctccaggcctttctctacaccctgaaggggagggaggaaaatggataaatgagagagggagggaacagtgcccaagcgcttggcctctccttctcttccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaa

SEQ ID NO: 5839 - DNA, 546 bp, Homo sapiens
gaactggccagggtataaaaagggcccacaagagaccggctctaggatcccaaggcccaactccccgaaccactcagggtcctgtggacagctcacctagtggcaatggctccaggctcccggacgtccctgctcctggcttttgccctgctctgcctgccctggcttcaagaggctggtgccgtccaaaccgttcccttatccaggctttttgaccacgctatgctccaagcccatcgcgcgcaccagctggccattgacacctaccaggagtttaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccac

SEQ ID NO: 5840 - DNA, 699 bp, Homo sapiens
ctccccgaaccactcagggtcctgtggacagctcacctagtggcaatggctccaggctcccggacgtccctgctcctggcttttgccctgctctgcctgccctggcttcaagaggctgaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtggagggcagctgtggcttctaggtgcccgagtagcatcctgtgacccctccccagtgcctctcctggccctgaaggtgccactccagtgcccaccagccttgtcctaataaaattaagttgtat

SEQ ID NO: 5841 - DNA, 1173 bp, Homo sapiens
ccatgcataaatgtacacagaaacaggtggggtcaagcagggagagagaactggccagggtataaaaagggcccacaagagaccggctctaggatcccaaggcccaactccccgaaccactcagggtcctgtggacagctcacctagcggcaatggctgcaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcgccaggggtcgccaatcctggaaccccactggcttagagggctgggggagagaaacactgctgccctctttgtagcagtcaggcgctgacccaagagaactcaccttattcttcatttcgcctggtgaatcctccaggcccttctctacaccctgaaggggagggaggaaaatggatgaatgagagagggagggaacagtgcccaagcgcttggcctctccttctcttccttcactttgcagaggctggaagacggcagccgccggactgggcagatcctcaagcagacctacagcaagtttgacacaaactcacacaaccatgacgcactgctcaagaactacgggctgctctactgcttcaggaaggacatggacaaggtcgagacattcctgcgcatggtgcagtgccgctctgtagagggtagctgtggcttctaggtgcccgcgtggcatcctgtgaccgacccctccccagtgcctctcctggccctggaaggtgccactccagtgcccatcagccttgtcctaataaaattaagttgtatcatttca

SEQ ID NO: 5842 - DNA, 550 bp, Homo sapiens
gaactggccagggtataaaaagggcccacaagagaccggctctaggatcccaaggcccaactccccgaaccactcagggtcctgtggacagctcacctagcggcaatggctgcaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttaggctggaagacggcagccgccggactgggcagatcctcaagcagacctacagcaagtttgacacaaactcacacaaccatgacgcactgctcaagaactacgggctgctctactgcttcaggaaggacatggacaaggtcgagacattcctgcgcatggtgcagtgccgctctgtagagggtagctgtggcttctaggtgcccgcgtggcatcctgtgaccgacccctccccagtgcctctcctggccctggaaggtgccactccagtgccca

SEQ ID NO: 5843 - DNA, 920 bp, Homo sapiens
ccatgcataaatgtacacagaaacaggtggggtcaagcagggagagagaactggccagggtataaaaagggcccacaagagaccggctctaggatcccaaggcccaactccccgaaccactcagggtcctgtggacagctcacctagcggcaatggctgcaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcacacaaccatgacgcactgctcaagaactacgggctgctctactgcttcaggaaggacatggacaaggtcgagacattcctgcgcatggtgcagtgccgctctgtagagggtagctgtggcttctaggtgcccgcgtggcatcctgtgaccgacccctccccagtgcctctcctggccctggaaggtgccactccagtgcccatcagccttgtcctaataaaattaagttgtatcatttca

SEQ ID NO: 5844 - DNA, 749 bp, Homo sapiens
ccatgcataaatgtacacagaaacaggtggggtcaagcagggagagagaactggccagggtataaaaagggcccacaagagaccggctctaggatcccaaggcccaactccccgaaccactcagggtcctgtggacagctcacctagcggcaatggctgcaggctcccggacgtccctgctcctggcttttgccctgctctgcctgccctggcttcaagaggctgactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatggggaggctggaagacggcagccgccggactgggcagatcctcaagcagacctacagcaagtttgacacaaactcacacaaccatgacgcactgctcaagaactacgggctgctctactgcttcaggaaggacatggacaaggtcgagacattcctgcgcatggtgcagtgccgctctgtagagggtagctgtggcttctaggtgcccgcgtggcatcctgtgaccgacccctccccagtgcctctcctggccctggaaggtgccactccagtgcccatcagccttgtcctaataaaattaagttgtatcatttca

SEQ ID NO: 5845 - DNA, 849 bp, Homo sapiens
caggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgaagaaacctatatcccaaaggaccagaagtattcattcctgcatgactcccagacctccttctgcttctcagactctattccgacaccctccaacatggaggaaacgcaacagaaatccaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcgccaggggtcgccaatcctggaaccccactggcttagagggctgggggagagaaacactgctgccctctttgtagcaaggctggaagacggcagccgccggactgggcagatcctcaagcagacctacagcaagtttgacacaaactcacacaaccatgacgcactgctcaagaactacgggctgctctactgcttcaggaaggacatggacaaggtcgagacattcctgcgcatggtgcagtgccgctctgtagagggtagctgtggcttctaggtgcccgcgtggcatcctgtgaccgacccctccccagtgcctctcctggccctggaaggtgccactccagtgcccatcagccttgtcctaataaaattaagttgtatcatttca

SEQ ID NO: 5846 - DNA, 837 bp, Homo sapiens
agcatcccaaggcccgactccccgcaccactcagggtcctgtggacagctcacctagcggcaatggctgcaggctcccggacgtccctgctcctggcttttgccctgctctgcctgccctggcttcaagaggctggtgccgtccaaaccgttcccttatccaggctttttaaagaggctatgctccaagcccatcgcgcacaccagctggccattgacacctaccaggagtttataagctcttggggaatggaagcctatatcacaaaggaacagaagtattcattcctgcatgactcccagacctccttctgcttctcagactctattccgacatcctccaacatggaggaaacgcagcagaaatccaacttagagctgctccacatctccctgctgctcatcgagtcgcggctggagcccgtgcggttcctcaggagtaccttcaccaacaacctggtgtatgacacctcggacagcgatgactatcacctcctaaaggacctagaggaaggcatccaaatgctgatggggaggctggaagacggcagccacctgactgggcagaccctcaagcagacctacagcaagtttgacacaaactcgcacaaccatgacgcactgctcaagaactacgggctgctccactgcttcaggaaggacatggacaaggtcgagacattcctgcgcatggtgcagtgccgctctgtggagggcagctgtggcttctaggggcccgcgtggcatcctgtgacccctccccagtgcctctcctggccctgaaggtgccactccagtgcccaccagccttgtcttaataaaattaagttgtattgtt

SEQ ID NO: 5847 - DNA, 659 bp, Homo sapiens
agcatcccaaggcccgactccccgcaccactcagggtcctgtggacagctcacctagcggcaatggctgcaggaagaagcctatatcacaaaggaacagaagtattcattcctgcatgactcccagacctccttctgcttctcagactctattccgacatcctccaacatggaggaaacgcagcagaaatccaacttagagctgctccacatctccctgctgctcatcgagtcgcggctggagcccgtgcggttcctcaggagtaccttcaccaacaacctggtgtatgacacctcggacagcgatgactatcacctcctaaaggacctagaggaaggcatccaaatgctgatggggaggctggaagacggcagccacctgactgggcagaccctcaagcagacctacagcaagtttgacacaaactcgcacaaccatgacgcactgctcaagaactacgggctgctccactgcttcaggaaggacatggacaaggtcgagacattcctgcgcatggtgcagtgccgctctgtggagggcagctgtggcttctaggggcccgcgtggcatcctgtgacccctccccagtgcctctcctggccctgaaggtgccactccagtgcccaccagccttgtcttaataaaattaagttgtattg

SEQ ID NO: 5848 - DNA, 1022 bp, Homo sapiens
aggatcccaaggcccaactccccgaaccactcagggtcctgtggacagctcacctagctgcaatggctacaggctcccggacgtccctgctcctggcttttgccctgctctgcctgccctggcttcaagaggctggtgccgtccaaaccgttcccttatccaggctttttaaagaggctatgctccaagcccatcgcgcacaccagctggccattgacacctaccaggagtttataagctcttggggaatgggtgcgggtcaggggtggcaagaaggggtgactttcccccactggggaagtaatgggaggagactaaggagctcagggttgttttctgaagcgaaaatgcaggcagatgagcataggctgagccaggttcccagaagagtaacagtgggagctggtctccagcatagaaagcagtggtccttcttggtggggggtccttcccctaggaagaagcctatatcacaaaggaacagaagtattcattcctgcatgactcccagacctccttctgcttctcagactctattccgacatcctccaacatggaggaaacgcagcagaaatccaacttagagctgctccacatctccctgctgctcatcgagtcgcggctggagcccgtgcggttcctcaggagtaccttcaccaacaacctggtgtatgacacctcggacagcgatgactatcacctcctaaaggacctagaggaaggcatccaaatgctgatgggggtgagggtggcaccaggggtccccaatcctggaagcccactggcttcgagggctgggggagagaaacactgctgccctcttttcagcagtcaggcgctgacccaagagaactcaccttattcttcatttcccctcgtgaatcctccaggcctttctctacaccctgaaggggaaggaggaaaatggataaatgagagagggagggaacagtgcccaagcgcttggtctctccttctcttgcttcactttgcagaggctggaagacggcagccacctgact

SEQ ID NO: 5849 - DNA, 588 bp, Homo sapiens
agcatcccaaggcccgactccccgcaccactcagggtcctgtggacagctcacctagcggcaatggctgcagactctattccgacatcctccaacatggaggaaacgcagcagaaatccaacttagagctgctccacatctccctgctgctcatcgagtcgcggctggagcccgtgcggttcctcaggagtaccttcaccaacaacctggtgtatgacacctcggacagcgatgactatcacctcctaaaggacctagaggaaggcatccaaatgctgatggggaggctggaagacggcagccacctgactgggcagaccctcaagcagacctacagcaagtttgacacaaactcgcacaaccatgacgcactgctcaagaactacgggctgctccactgcttcaggaaggacatggacaaggtcgagacattcctgcgcatggtgcagtgccgctctgtggagggcagctgtggcttctaggggcccgcgtggcatcctgtgacccctccccagtgcctctcctggccctgaaggtgccactccagtgcccaccagccttgtcttaataaaattaagttgtattgtt

SEQ ID NO: 5850 - DNA, 5442 bp, Homo sapiens
taatagtcacatgacacgtttcccgtcaagatggcggatactctcccttcggagtttgatgtgatcgtaatagggacgggtttgcctgaatccatcattgcagctgcatgttcaagaagtggccggagagttctgcatgttgattcaagaagctactatggaggaaactgggccagttttagcttttcaggactattgtcctggctaaaggaataccaggaaaacagtgacattgtaagtgacagtccagtgtggcaagaccagatccttgaaaatgaagaagccattgctcttagcaggaaggacaaaactattcaacatgtggaagtattttgttatgccagtcaggatttgcatgaagatgtcgaagaagctggtgcactgcagaaaaatcatgctcttgtgacatctgcaaactccacagaagctgcagattctgccttcctgcctacggaggatgagtcattaagcactatgagctgtgaaatgctcacagaacaaactccaagcagcgatccagagaatgcgctagaagtaaatggtgctgaagtgacaggggaaaaagaaaaccattgtgatgataaaacttgtgtgccatcaacttcagcagaagacatgagtgaaaatgtgcctatagcagaagataccacagagcaaccaaagaaaaacagaattacttactcacaaattattaaagaaggcaggagatttaatattgatttagtatcaaagctgctgtattctcgaggattactaattgatcttctaatcaaatctaatgttagtcgatatgcagagtttaaaaatattaccaggattcttgcatttcgagaaggacgagtggaacaggttccgtgttccagagcagatgtctttaatagcaaacaacttactatggtagaaaagcgaatgctaatgaaatttcttacattttgtatggaatatgagaaatatcctgatgaatataaaggatatgaagagatcacattttatgaatatttaaagactcaaaaattaacccccaacctccaatatattgtcatgcattcaattgcaatgacatcagagacagccagcagcaccatagatggtctcaaagctaccaaaaactttcttcactgtcttgggcggtatggcaacactccatttttgtttcctttatatggccaaggagaactcccccagtgtttctgcaggatgtgtgctgtgtttggtggaatttattgtcttcgccattcagtacagtgccttgtagtggacaaagaatccagaaaatgtaaagcaattatagatcagtttggtcagagaataatctctgagcatttcctcgtggaggacagttactttcctgagaacatgtgctcacgtgtgcaatacaggcagatctccagggcagtgctgattacagatagatctgtcctaaaaacagattcagatcaacagatttccattttgacagtgccagcagaggaaccaggaacttttgctgttcgggtcattgagttatgttcttcaacgatgacatgcatgaaaggcacctatttggttcatttgacttgcacatcttctaaaacagcaagagaagatttagaatcagttgtgcagaaattgtttgttccatatactgaaatggagatagaaaatgaacaagtagaaaagccaagaattctgtgggctctttacttcaatatgagagattcgtcagacatcagcaggagctgttataatgatttaccatccaacgtttatgtctgctctggcccagattgtggtttaggaaatgataatgcagtcaaacaggctgaaacacttttccaggaaatctgccccaatgaagatttctgtccccctccaccaaatcctgaagacattatccttgatggagacagtttacagccagaggcttcagaatccagtgccataccagaggctaactcggagactttcaaggaaagcacaaaccttggaaacctagaggagtcctctgaataatggatatacaccaaactggatacccaactttggaaattctgactggtctcagagtctacttgatagaaggactgtttgagaaatgttagaaagcagcagcaattataaggcaaaataggtaatagaaatccaaaaggggattttccttatagaggacattccaagaacacacaacacttataaagcacattgacttgctcattttaaataccaaacttgtgtgactagcagatgaaaattataaatcaattgattctcaggaatgtaactgtggatatgaaagtgatcctatgcattgttaataattccatggtcttaggacaattttgcttaccactttggatctttgtttgaaagccacattttcagaaccagctcatgtattttctttggttatttgaattttattttctttatggacaagagcatcataacataatgataaaaacatatagaaaaactaaagtatcatgatctagatagaagcctgtatttggaatacaggtttgttttgctttctatgttgagaagcattgaaaatgctaatataaaggtgtttagacatttttacgaataagtcagtagtgttttttagtatcagtagtgatatttgtttgtaaattatttacatattgggaaaggtcaataatgaagaaatgaaagaatggaaggaaaggtgtggataggctcattggtatttgaatattctgtctgtcaagtaactagagtattaggctaattgtctacagacctaatttaatcctggctgtcctactgatgatatttggtaaattgtttaacttctgagcctacgtttctccatatataaagtggaaatagtattactatgcctactatatgagaatggttatgaagacaatgcaatgccatgtttagaatcggtttgccagaagaaaattgttttagaattttcccattgacttgatgaatctcaaaagtctcacgcaggaaataattgcttgctgtcagtcaacttccaaacaaaatagatcacagtgtttttattgcattaagctttttaaatgaaaatttcttttttaaagtagtattttatagtcttacagaccagtaaaaatagtaacaagtagaattgtggttttgaaatattactaaggaaaacactctataaattgttttattccttttctggtaggtaaacctgcaaccaccaaggactccaaattgtgtatgacagttggtaagccctaatatacactacataaaaacgttagggctgcctgtaatcccagcactttgggaagctgaggtgggtagatcacttgaggtcaggagttcgagaccagcctggccaacatggcgaaaccctgtctctactaaaaatacaaaattttagctgggtgttatggtgggcacctgtaatcccagctactttgaagatgaggtagcagactcacttgaaccagggaggcggaggttgcagtgagccaagattttgccactgcactccagcctgggtgacagagcaagactctgtctcacaaaaaaaaaaaaagggggctgtacataggcagcaaactaagctgcagtgatgttgcctatatttaaattttctcaaatggccaagctctgatggtctactttatttgagcaatagttgagacttataattgcctataaataaacaaacaaatgaactatttgtttttttttctcacaacatctggcctatattgtctgtcaggaagccatggctccaatgtaaagtacatagttcttacatacttcaactgcagctggtccctgacctcaccaggtttcagagatgttcttaaaggaagccagctgtggcaggtcacagattcatgggaaatggaaagaaccaaggaatatagctcttgcctcacctttctacccactgcagatatagttcaagccagagtaatggaagaacttaacttactagcctctcaggctgctcctatccctacctcccagtgtacagcccctccccatctctttagtcccctttccctcacttccccttttataatgtcacacaaatcagggacagtaggatcacattataacctactttgtcatagggattcgatttttcttatatcaaatcatgtttcctgaaacccagctggggcatatgcactcaatgtctaatacatacttattaatgtaccggatattggccttgcccctggatatcagcaatatattataaaaggttccagtagatgagacgattgagtctgaatacaattgcagtaaattgtgccaataaagatattgtactgttacggtcttagagttaaagccgcttgaatgcagcatgcacattcatgtaaacagacaatcagggtaggcctagaataaccacaaaaattctattggccttactgcagccacctatatgtagaacaatggaggagatagtttgtggtccattattgtaccctgtttcatccattagcatcagaatctctctttcaggtcatttattaaatatgattgaaatgtttaaaagttcctgaacatgattcatgatgattaaaatatcatacaactgataaaagactttaagaactttatatatttcctgttgcctcaaaatgtaacagaaattattcttagagctttgattttagctatcctaattactgcaaataaatatttgttcttatagttttaaatcaaaaagaaaagtcttgttataaaaccttaagcttgaaatcatattaataaaatatattgtacatagtggaaaattttcagtagctaatttaaaatttcagaaaatgctattaaagaattttgattcaagtatttaaactgtttagttatgcatgcttcttattaaccgaaaatgataataccatttagtttagtgatcagtatgagaagcaatacctaatcctatgttgctattgtattttttcctagttggtgtgcctgctcagaaaaacatatactgtatgtgtatacatacctgtgtatatataaaaggtcaatttatatatttttctataggaaaatggagtaacaagttccctatctcccatatttatttgtccatagtaaaatggccacattgatgataatttctagaactagtttctgagattgtcagccctttgtctaaaataatggcagtattaatgattgacttctgtcactgccatagttacctggattgtcagccttggtagcctttgtctaaagtcctaaagagttccaaaaaaaatgtgttgaaatttaattgctaaatagtggttggtgattctttacagtaggaattgtaataattttcttgcaaataagttatttactgctattgatattgaataatttgtcttttattcagatatatttcaaaaagcatgaatatatgattattcataaattgtatactttaccagtaagttttcagaggaaataaagacttttaaatccttttca

SEQ ID NO: 5851 - DNA, 2820 bp, Homo sapiens
cgtcaagatggcggatactctcccttcggagtttgatgtgatcgtaatagggacgggtttgcctgaatccatcattgcagctgcatgttcaagaagtggccggagagttctgcatgttgattcaagaagctactatggaggaaactgggccagttttagcttttcaggactattgtcctggctaaaggaataccaggaaaacagtgacattgtaagtgacagtccagtgtggcaagaccagatccttgaaaatgaagaagccattgctcttagcaggaaggacaaaactattcaacatgtggaagtattttgttatgccaggtccacgctgcttttatgagctgtaacactcaccgcgaagatctgcagcttcactcctgcgcccaccgagaccacaagcccaccgggaggaacgaacaactccagacgctctgccttaagagctgtaacattcaccgcgaaggtctgcagcttcactcctgagccagcgagaccacgaacccaccagaaggaagaaactccgaacacatctgaacatcagaaggaacaaactccagacgtgccaccttaagagctgtaacactcaccgcgcgggtccgcggcttcattctttaagtcagtgagaccaagaacccaccaattccggacacaccgatagcattctaatattttacatttgattgcaaggaggactaggcgagaattcaaatggattagtgcaaacccattaccactgcttggaaaatacgtcaaagtatttgggcaatataattctaatatatgtattctaatataaatatatagggtgtatttatatattatgtattctaatataaatatataggatagttattttttgattaccatgacttatttaaaaagtattctgaagtattattcaacttaaaggttttcatgatcatttcaacattaaatttaatacgttgggtattgcaaaacaggctaaagactaaaatgtaaattgtagtaattattctatcataggctaggttcaaacatcatagactgtaaagaactatccagattgttttatcagagctttgttttcctgattcttccttacaataagtgggctacttaatattttggacctaaaatatttttgctacacaaagattgtttttcattgaagtgattttttgtgattacacaatcgagttatggaagggaaatgaaaaaggactagtgtttattggatattatctttgtggcaactgctgtaacctgttgctttacatattaatttcatttattctgtgcagcagtcatgtgcatgagctataggtacatcttactgacaaacagaagctcaaggaatgctagagatagcagagccaaatttgaacttgtgtttttctaactcaaaaacgtgtgctatttccagtgtatcatgttgtatttcagtcatcaggtaaacacatgtatgcacatcaagggaaccaaccgttccaccaagtgaattaagtatttcctttgtgaagactagcacctaagaaagtgcatttacttctttaatttactggaatactatatagtattgtaatgtagttatatctgtaatgagaaattaaagtgcctaactcccagtgttaggaagctatgggaagaatccaatattctttagttgttgagaccagtttatatgccatgggattttttaaattgatacataataattgtatatattcatgggatacaatatgttttggtacatataaacattgtagaatgatcaaattaggctaattagcatatccatcaccttaaacctttattattttttgtgagaacattcagaatcatctcttttagctatttgaaatatgcaatgcattattgttagctatactcaccttactgtgtgatagagtaccagaatgtattcctcctacctaactgtaacattatacccattgaccaacctctcctcatcttcccctccctcctgttctccccagtctctggtaaccactatcaagttttttagatttcacatatgagtgagatcattcagtatttttctttctgttctcagcttatttcacttaatataatgttctccaggctcatccatgttgtcacaaatgacaggatttaattttttttatggctgtgcagtattctattgtgtatatatgccacattttccttgttaattcatttgttgatgggcatttaagttgattccatattttcgcaattgtgaatagtgctccaataaacatgggagtgcagatgtctcttcaacctactgatttcatttcctttggctatatacccagtagtgagggtgaagattgctggatcatatgatagatttatttttaattttttgaggaacttctgtactgttttccataatggctgtactgatttgcattcctaccaacagtgtgtgagagttcttctttcttaccatgtaatagtttcatagtttatgtggggaaataaaagtagctattgtttctagttttagatcttgaacagactataaaaaggtgcaatatattaattcacacttaaatcacacaaactcaagttattcttaggtaaaatatcgttgcttgttaattgcataaagtcatctagtttctttagtgagaagagattttatctttctaaaatattaacaatagctttatacattttctgtcctattttctgcattgtactgaacgttgtttccctttttctggtataatattaaagcaggatgaaaacttatttgttaccttcaaatgaaccaactctaatgtattcataccaaaataaagatttttttgcaataggaatctaaaa

SEQ ID NO: 5852 - DNA, 2000 bp, Homo sapiens
aagatggcggatactctcccttcggagtttgatgtgatcgtaatagggacggtcaggatttgcatgaagatgtcgaagaagctggtgcactgcagaaaaatcatgctcttgtgacatctgcaaactccacagaagctgcagattctgccttcctgcctacggaggatgagtcattaagcactatgagctgtgaaatgctcacagaacaaactccaagcagcgatccagagaatgcgctagaagtaaatggtgctgaagtgacaggggaaaaagaaaaccattgtgatgataaaacttgtgtgccatcaacttcagcagaagacatgagtgaaaatgtgcctatagcagaagataccacagagcaaccaaagaaaaacagaattacttactcacaaattattaaagaaggcaggagatttaatattgatttagtatcaaagctgctgtattctcgaggattactaattgatcttctaatcaaatctaatgttagtcgatatgcagagtttaaaaatattaccaggattcttgcatttcgagaaggacgagtggaacaggttccgtgttccagagcagatgtctttaatagcaaacaacttactatggtagaaaagcgaatgctaatgaaatttcttacattttgtatggaatatgagaaatatcctgatgaatataaaggatatgaagagatcacattttatgaatatttaaagactcaaaaattaacccccaacctccaatatattgtcatgcattcaattgcaatgacatcagagacagccagcagcaccatagatggtctcaaagctaccaaaaactttcttcactgtcttgggcggtatggcaacactccatttttgtttcctttatatggccaaggagaactcccccagtgtttctgcaggatgtgtgctgtgtttggtggaatttattgtcttcgccattcagtacagtgccttgtagtggacaaagaatccagaaaatgtaaagcaattatagatcagtttggtcagagaataatctctgagcatttcctcgtggaggacagttactttcctgagaacatgtgctcacgtgtgcaatacaggcagatctccagggcagtgctgattacagatagatctgtcctaaaaacagattcagatcaacagatttccattttgacagtgccagcagaggaaccaggaacttttgctgttcgggtcattgagttatgttcttcaacgatgacatgcatgaaaggcacctatttggttcatttgacttgcacatcttctaaaacagcaagagaagatttagaatcagttgtgcagaaattgtttgttccatatactgaaatggagatagaaaatgaacaagtagaaaagccaagaattctgtgggctctttacttcaatatgagagattcgtcagacatcagcaggagctgttataatgatttaccatccaacgtttatgtctgctctggcccagattgtggtttaggaaatgataatgcagtcaaacaggctgaaacacttttccaggaaatctgccccaatgaagatttctgtccccctccaccaaatcctgaagacattatccttgatggagacagtttacagccagaggcttcagaatccagtgccataccagaggctaactcggagactttcaaggaaagcacaaaccttggaaacctagaggagtcctctgaataatggatatacaccaaactggatacccaactttggaaattctgactggtctcagagtctacttgatagaaggactgtttgagaaatgttagaaagcagcagcaattataaggcaaaataggtaatagaaatccaaaaggggattttccttatagaggacattccaagaacacacaacacttataaagcacattgacttgctcattttaaataccaaacttgtgtgactagcagatgaaaattataaatcaattgattctcaggaatgtaactgtggatatgaaagtgatcctatgcattgtt

SEQ ID NO: 5853 - DNA, 7078 bp, Homo sapiens
ataagaaaaaaaatattttaaaagggtaaccgttaaacagctaggacctgcaacttcagtgcttctgggataactggaacatcagaaggacagattttattacagcataatcacacctcatttctttcatcagcagttgtcaccagacgctgttacttcctaaaatggcggacaatcttcccacagagtttgatgtggttataatagggacaggtttgcccgaatccatccttgcagctgcatgttcaagaagtggtcagagggttctgcatattgattcaagaagctactatggaggaaactgggctagtttcagcttttcaggattgctatcctggttgaaggagtatcagcaaaacaatgacattggggaagaaagtactgttgtatggcaggacctgatccatgaaacagaagaagccatcactcttcgcaagaaggatgaaactattcaacacacagaagctttttgctacgccagtcaggatatggaggacaacgttgaagagattggtgctctgcagaaaaatccttctttgggggtgtctaataccttcactgaagttctggattctgcattacctgaagaaagccagttatcgtattttaatagcgacgaaatgcctgcaaaacacactcagaaaagtgatacagagatttcactagaagtaactgatgtagaggaatcagtggagaaggaaaagtattgtggagataaaacttgtatgcacacagtttcagataaagatggagataaagatgaaagcaaatctacagtagaagataaggccgatgaaccaattagaaataggattacttactctcaaatagttaaagaaggcaggaggtttaatattgatttggtgtcaaaactgctgtattctcaaggattgctaattgatcttttaatcaaatcagatgttagtcgttatgtagaatttaaaaatgtcactaggattcttgcatttcgggaaggaaaggtagaacaagttccttgttccagagcagatgtctttaatagcaaggaactcaccatggttgaaaagaggatgctaatgaaatttctcacattttgtttagagtatgaacaacatcctgatgaataccaagctttcaggcagtgttcattttcagaatacttaaaaactaaaaaactaactcccaaccttcaacattttgtactgcactcaattgcaatgacatcagaatcatcttgcactacaatagatggtcttaacgcaactaaaaacttccttcagtgtctcggacggtttggcaacaccccctttttatttcccttgtatggccaaggagaaattccccagggtttctgtaggatgtgtgcagtttttggtggaatctattgtcttcgtcataaagtacaatgctttgtagtcgacaaagaatctggacgatgtaaagcaattatagatcactttggtcaaagaataaatgctaaatattttattgtggaagacagttacctttctgaggaaacatgctcaaatgtgcagtataagcagatctctagggcagtactcattacagatcagtctatactaaagacagatttagatcagcagacttccattctgatagttcctccagcagagccaggagcttgtgctgtacgggtcacagaattatgttcttcaaccatgacatgcatgaaggacacctatctggtacatttgacatgttcatcttctaaaacagcaagagaagacttagaatcagtggtgaagaaattattcactccgtatactgaaacagaaataaacgaggaagaacttacaaagccaagactcttgtgggctctttattttaatatgagagattcctcgggaatcagcagaagctcgtataatggcttgccttccaatgtttatgtctgctctgggcctgactgtggcctgggaaatgagcatgctgtcaagcaagctgaaacacttttccaggagatctttccaactgaagaattctgccctccacctccaaatccagaagacattatctttgatggtgatgataagcagccagaggctcctggaaccaataatgtagtaatggccaaactagaatcctctgaggaaagcaaaaacctagaaagcccagagaagcaccttcaaaattagaaaagagcaatctcgaaatgctgttttggacctccttcatggcatcagaattttctcatttaaaggacagtttcccatatgagtaattagaagtggttatatatgatgaatgctatgcagatgttgtctttaactctcagacattcagcattgaatatctttgttaacctatcaatgagtgatttattgattattgaacattttgtttagaatgggctatatgacccagaatcttaaaacagagttagctttattttagtattgggtatatatgtaagggttccatattagcaactcagcttaaaggtaatgtatttgctaatgatcttcagattttatctttgtctacagaacaattagtaatacccaagtaatattttaattacttttgcagctgttacagttgctgcggcctgttcgaatagtgaaacatacacaaatggtaaattatgtggatcttttgcatataatataaatgtatagacatggtggtaggaatagcaactaatacaaatgccaatatgataataaaatacatttgtctataatcgtttaaagattagctttgcatgatcctttatgcactgtgaaggtctgaagtttataatactcacttgacccttgtaactgatgaggcaatgatgccaccacagtattctaatttacaaaaagaattggagttcaattagtggttgtaaagctcattttggggaggttgattgcaaaggaaatttgaaagataagatttattcttatttaatacttcagaaaatttctgcagagccctgccctggcacttaaaatagcttccaataagtaacttagaccaaaaggaaaaatgaagtgccccaggagaagatacttcagaagggctgttctgaaattcctaaggaggaattcttaggaattcctaaggagaaacagagtgaggcctttttaacctgagattacagatacttataaaaccctctataaatagattacccaaggtttttcagtgagaatgaaacataccaccttgttggctctaccactttaattaatatcactataacataactgataggaatgaatcaaaggaggatttaccatgccctttcggttgtgtcccacttaacaaattgtgaagtaacaattttctgtaatctctcttgcctcttagctgttatccagagtatagaaactttttttctcccagagccacccaacgtcataaaactggtagtactctaatggtgaaaacctgtggagctgtcagaagacatgaacttgcttttcctctagtccagtttccattcttcagtcagagtatgatgatccctgtgacagtttttgctctgaaatagtatttatcatgtgtttggtacctagtattatgctttctcatgacagtttctcaacaatcctgtgaggcaaattcgcatgtaccctctgtattagtgtgttctcatgctgttgataaagacacacctgagatggtaatttgtaaagaaaaaggtttaatggactcacagttccatgtggctggggaggcctcacaatcatggtggaaggtgaaaggcacgtcttacatggcggtggacaagagagaatgagaactaagtgaaaagggaaacccttttaaaaccatcagatatcgtgagacttatttactaccatgagaacagtatgggggaaacaactccatgattcagttatctcccaccaggttcctcccacaacacgtgggaattataggagctacaattcaagatgagatttgagtgggaacacagccaaaccatatcaccttcaaagaagaaataagagaattattagtaatttgctcagaatctggtatgtggaagagccaacatggggacccagccttttgtgattctaaaacctttgatctttctactaacattcactgttagagagtgtaggcgctgcaggagaaagagaaagtgcccacgaaaattagtctagcattgccgggggtaaaaagcacacactggtcctgcagcttattgaatcagagaaatgtgaagataagatgaactaaacaaacatattttagagcatggatctcgaagcagaatttggctaaattttaacaaaatgttcttcagtaacacatctcatgatctgaagattgtgttacaaaaaatattatcaggccaaaatttgttcggaatacactaatttttgctcctctatatgtgaggaaaatgagactagacagatttaagtaattgacaacttacttaaagtagcaaagtcatggattgtattgacttttaaaaatatagtaaaagtcatatttaaactttatcctaaagtttaaatctaacagaacaactgaaatacttgaaatagacctataaaatagtaattaaaatgagaaatacataagatgataaataaaatgaaggtgaaggtattccagatctaccgaaaagattttcagtatcacagattattcataagaaattgagaaaaggaacaatcagaagttgcaaaagatggtatagccgaatataatggaaataggaaaaattagtcgaaaataaaggttgatttagaaatgaagaaaatgaatatatttcttaatacaaaataagtgggaaatgagaagttataccaataaaaagcatttaaaaatttaggggatattgtaacccagtataattttctgacaggttggactttgaccctaatggacttactggtgaactttttcaaatgtttaaataatgtctatccatgtatcatgaaggacagtatgcttcaaattgtcttttgaggcagacatgttctcagtactaaaagacatttttagaaggattttattctcaacagatgcaaaatgcaaaataaaatattggcaaacaatacagcaacaaataatttactatcactcaggattataaggctggtgttaagcagaacagccattaaatcagcatcaaaagaacaaatagtaaaatccaaagtattaattacagataacttttcaaaaattcatcattcacccttgatttaattatttctctggcaatgatttaatagacttctcggagtctgttaagtacttaaaccaagaactaccattattcctactgggaaaacataaacatttctcaagtggaaagtaaacagtgttggcactatttttatatatggttaaagagacctgtcattgcaataaaagccagcattcacaaaatgaggaagataaggaaagtagcataaatattttctattaacatggctttacaactgctaaaacttatagtataaaaatgtactaacaaagactaattcaagaagttgcaggatacacaatttttaaaaatctcatttctacatcttagcagtgacaaactgcaatttaaaaagtgtgtttggttattaatatatatgagacttttaaagaaagttatataactacatagagataaattaagaaagatgcctaaatagaagcaagtttaaagagctatatttttaaacatgaacaaactcccatgggagccatgccagtgtagtggaaaagtagtacatggggagatggggagtttttttgaaaaccagaattacagttctcatttcactacttaccagttgtatactcttgggaaagtcactcctagtatctatttcaccatctacagaagagaaatacttcacagaattattgtggggattaagttagataatgtgttttaaaatataaagctacatccaaagaaatgccaatatgtgacattagtatgaaatttactacagttccatttaacattccaactggttgctgtgtggaatatggcataattgtaataaattatttaggaaagcaagcaaagatgtaagtttttttaatttagggggaaaaaatgggagccttgctctccaaatccttaaaacatgctattaagcaacctttctgaatattctgtggtgccaagtagaaagtttaactgaaattaataagccaatggaaagaaagaaatattaataactgctggtggaaagactagctagatgtcagtgtggaaagattagatccactttacatgtgatattccaaatgaattaaaatgttaagtataaaaagaaaaatactacaagtctcacaccaatagtggtataaaggaacttcatggcaattggcaaggtagatcaactaagagaaaaagttttaaatgtgtagtaaataggaaaaagacaaaacaagatggaatttaaaagaagctatttgcattacacatggatgcactcagtttttgtaaaactatatgcatatccataagggtttgtactcttaggcaaatttataaagcgatcgtgtataaatgatataaaaaatcaatttgaatggtattcaaatttcctaatattaaaaatgcaactttgacttagttcatgctattgtattagcaaaactgttttaattgcatgtgtccttatagcagcagcattgtgtattagtagccttttaagagaactgtgtagaagactataaaaagggctttataactgatcttttgacatactcactttgagtggcatatgcccaggaaaatatttaaaagaaagaaaagctatttgtacaaagttttctagcagttccactcagataactttaagggggaaaaaagcccaacgattggaaatggttaagtaaattttggtgtattgctagtgctatcacagaatgttatatagccattcaataatattgatatatgtcaaattgtatgcaaaaaagtgagattcaaaaatgttaataagaacataaattgtgtttactgatacatgtgaaaatttaggtctacattgaaaagaatcagaagataacatgtaattcagtttaacattaggggttctttatttttcttctgttaaatattgatgtatgcaataaaaaataaaagattaattggtaaagtggtttactg

SEQ ID NO: 5854 - DNA, 2674 bp, Homo sapiens
cccgcctcttcctcccttccttctttccttgctttcgccgcgcactccgccgccatggagcagcgccgcgtcaccgacttcttcgcgcgccgccgccccgggcccccccgcatcgcgccgcccaagctggcctgccgcacccccagccccgccaggcccgcactccgcgccccggcctccgctaccagtggcagccgcaagcgcgcccgcccgcccgccgcccccggacgcgaccaggccaggccaccggcccgcaggagactgcggctgtcggtggacgaggtttccagccccagtacccccgaggccccagacatcccagcctgcccttctccgggccagaagataaagaaatccaccccggcagcaggtcagccgccccacctgacatccgcgcaggaccaggacaccatctctgagcttgcgtcatgcctgcaacgggcccgggagctgggggcaagagtccgggcgctgaaggccagtgcccaggatgctggggagtcctgcaccccagaggccgagggccgccctgaggagccatgtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggcgttttgaggagtgcaatgttggccagatcaaaaccgtgtacccggcctcctaccgcttccgccaggagcgcagtgtccccaccttcaaggatggcaccaggaggtcagattaccagctcaccatcgagccactgctggagcaggaggctgacggagcagccccccagctcacggcctcgcgcctcctgcagcgacggcagatcttcagccagaagctggtggagcatgtcaaggagcaccacaaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccaggatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggggaaatggagaagcacctgctgctcctctccgagctgctgccggactggctcagcctccaccgcatccgcaccgacacctacgtcaagctggacaaggccgcggacctcgcccacatcactgcacgcctggcccaccagacacgtgctgaggaggggctgtgagcctgggggccactgtggacagacgtgggcttcagaagctcgctggcctgggcccaccagcattttcttttatgaacatgatacactttggccttcctttccccagcgcccctgagggccagaggcagatgtgggctgcaggctgcacagcccgagggtctctggctgcgggcggtgggccccttcatggggctcacctggtggattcacattaaaccggtttctgtgggcacctctgtccttgctgctggtggggaagggaagccagatccagcaccccctggggggccatcgggagtgtggctgggggtgaagggggctctgtggcaatatggggttgggtagtgtgggtggcaggccatcccctctaatcttggaacctctgaatatgggacctcccacagcaaagggtgacttttgtcattaagaaagactggggtgggtgtggtggctcacgcctgtaaccccagcactttgggaggccaaggtgggcagatcacgaggtcaagagatcgagaccatcctggcgaacatggtgaaaccccatctctactaaaaatacaaaaaattagccgggtgtggtggtgggcacctgtcgtcccagctactagggaggctgaggcaggagaatggtgtgaacccaggaggcacagcttgcagtgagcgaagatcgcaccactgcacgcactccagcctgggtgacagagcgagactccgtctcaaaaaaaaaaatttcaagactggagaggtgatcctgaattgtccagctacgccccatgtcatcacagggccttcatgacagggccagagccagccagctttgaagacgcggccctgccccgacacaggcagcctggagaagctgggcaggacaagtaggacatccctggagcctccagaagggactggcctctgcccacaccttgacttcagtatttctgacctcctaaactctaataaagtcatgcttacagccact

SEQ ID NO: 5855 - DNA, 2250 bp, Homo sapiens
gggcttcgatgcagcaacaacagcagctagccagtgccagaaacagaagactggcccagcagatggagaatagaccctctgtccaggcagcattaaaacttaagcagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcagtgctgtgtaccctgataattgtcgggccctactcccttcccttttctcttgggctgcttatggacacgtttgtttaacatctttaagcctgaatttgtattaatataataacttctgaaatcacatatttttaatagtgctgcatgtcttttatcaataccattccttttctgataatgtgcaatggtgagaggctatgacctgcgtaacaacaggtaattcatgtcatctccattccattttaaaacaccctgctgttgcttgaatcaaagcacattcaagttctagaaacaagtcaaacataagaaatttataggtcttttggcctatatctctttgttcctggtgctagtaaaacactgatacagctggaaaaagaggacaagttgacccacagcacttacctatatatgttcatttggggcactattactctgttccctgtatagttcttgttccctagaagaatctgttgagatcaggaaccatagcatttatttttaaatttaccataatgctaggcatctatctgattattcagtagatatttattaaatgtatgtacttactaattgaattaactcccaacttccaaaaatggatttgtggtcagacttgttgaattgattgaataaagagtagcttaatctgttcacagtatgcagcttgccccagccaacctaaaaactaactgaattaccttcatttaaccctcaccgccttcctttggttagaatctactttgtgtctcttggatttacctgcatatacattgtatgcctcctctctaaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggttagtcagctaccaacttcagagagtagctcccccttactttcctcccttaaaaactcagagccacctttctgcacagcttcaagtcataggcaggcttctttgtttgtcttgttttgttatttgaaactggcttatttttcaaattaccatgctggtagtgcaaaagtctcatgatttttccaagaatcaatcaagtgcatattatagagccagattatatgccatcttcctccaagctcttgcaaatttaaattgtatagttgaaaataccccccaaaatggtcagtttagggttttgcctttctctgcccctgtcccaccaccatcaccaccacataccaccctgtagctccaaatcctggtttgagtcacatgagaatatagaagagagagagagatacaaagatgaagtagagttaagagggtggtgagacttggagctgggcattggctctgaaaccaaataaattcaatgtcacatttggtgcctgtggagaaccagagatgactttttttgcttaaggtagagagcaagatggaattattatcagttaactaactggctcttattgataatcttgcctttgaaatttattgatgtttgtcttgtgacctcatgacccagattgggaaagagtttaatgatgttgctgctgttaatactaaatctcatgggagccttctggtttagagcttagtggaaaactcccaacacctgtccagaaaaaaaacactattgaagcccctgtgtatatttgctttggttctcttaaaaggtgtcttgggtcttccataacttatgaccttgaagttgccaaggaataataactgttaggaaagaaaagttgataaccaagggcttgttttcttctctcccattatatgatacttactgagtgaagtgcaagctagtttgggtttcaggatgaaataacatgtttccaaattatcttgacttggatcctgagagacatcacgagggtgggagagactaaaatagcttttcaaaaagctgagt

SEQ ID NO: 5856 - DNA, 1094 bp, Homo sapiens
gtgctgcacttagctgcatttctaagtttctgattcttgcaagtttgtggaaacagaggagtctttaacccacatcagccttgatctaagtgtaccactttacttaaaagttcgtgggatctggagctcctggtctagcaagccatgaaaatgccaataaatgtttgtaataaagcttttatttaaacatccattttgttcgaccttgaagctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttg

SEQ ID NO: 5857 - DNA, 810 bp, Homo sapiens
atggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttg

SEQ ID NO: 5858 - DNA, 2096 bp, Homo sapiens
tcagacaagcactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaactgttcgcttaaatcca

SEQ ID NO: 5859 - DNA, 1923 bp, Homo sapiens
gttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagatggctgcacagtcagcgccgaaagttgtgctaaaaagcaccaccaagatgtctctaaatgagcgctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaactgttcgcttaaa

SEQ ID NO: 5860 - DNA, 1077 bp, Homo sapiens
ggcggtccgggcgggtgactggcggcgggcgccgcggtcgggctggctgccgggcagcatggaggagctgagcagcgtgggcgagcaggtcttcgccgccgagtgcatcctgagcaagcggctccgcaagggcaagctggagtacctggtcaagtggcgcggctggtcctccaaacataacagctgggagccggaggagaacatcctggacccgaggctgctcctggccttccagaagaaggaacatgagaaggaggtgcagaaccggaagagaggcaagaggccgagaggccggccaaggaagctcactgccatgtcctcctgcagccggcgctccaagctcaaggtgggtggctgcgctgggtatgctgaccccacctcccagcacccccttggcgtagggggcaggcagagggagggtttggggccctcaggaagggggtggcacttctgccaacagtctgtccctctactcggaaaacaggagccccctttcttcctgtctctcagcttctgctgccaggggccccagccggctgagagttcctccccgcccctcccaggggcttcctgcttcagcctgtcctgcacgcctctctgctgggtggcagggtcaaactgctgcagacaagcactcttccctcccagggggtccttgggggacggaaaggaacaggaagcatgcgtacagtaggtgctcataggattgccggctggatgtgactcaaaagcctaagatttgggggctactccgggcccacctgcgggtgcaccttaaatcgaggtggccacgaaaggcagggctgactgaatagccagggggtgccaggaggggccttggaggagggcagaggcagtgtgggctgatgatgtgctttggccttctcgggactgtcctgtcacccctcctcgctacagtgatgggctcaccccgccacaggtatgcatgcgcccctggggtccgtggtagggcccctccctcccctgaggacaggtgaggcaggacaggatgggggaggagggcctggcctcagtcccgggtgtggctttgattccctcctccgggcactgtccctg

SEQ ID NO: 5861 - DNA, 4265 bp, Homo sapiens
ggcggtccgggcgggtgactggcggcgggcgccgcggtcgggctggctgccgggcagcatggaggagctgagcagcgtgggcgagcaggtcttcgccgccgagtgcatcctgagcaagcggctccgcaagggcaagctggagtacctggtcaagtggcgcggctggtcctccaaacataacagctgggagccggaggagaacatcctggacccgaggctgctcctggccttccagaagaaggaacatgagaaggaggtgcagaaccggaagagaggcaagaggccgagaggccggccaaggaagctcactgccatgtcctcctgcagccggcgctccaagctcaaggaacccgatgctccctccaaatccaagtccagcagttcctcctcttcctccacgtcatcctcctcttcctcagatgaagaggatgacagtgacttagatgctaagaggggtccccggggccgcgagacccacccagtgccgcagaagaaggcccagatcctggtggccaaacccgagctgaaggatcccatccggaagaagcggggacgaaagcccctgcccccagagcaaaaggcaacccgaagacccgtgagcctggccaaggtgctgaagaccgcccggaaggatctgggggccccggccagcaagctgccccctccactcagcgcccccgttgcaggcctggcagctctgaaggcccacgccaaggaggcctgtggcggccccagtgccatggccaccccagagaacctggccagcctaatgaagggcatggccagtagccccggccggggtggcatcagctggcagagctccatcgtgcactacatgaaccggatgacccagagccaggcccaggctgccagcaggttggcgctgaaggcccaggccaccaacaagtgcggcctcgggctggacctgaaggtgaggacgcagaaaggggagctgggaatgagccctccaggaagcaaaatcccgaaggcccccagcggtggggctgtggagcagaaagtggggaacacagggggccccccgcacacccatggtgccagcagggtgcctgctgggtgcccaggcccccagccagcacccacccaggagctgagcctccaggtcttggacttgcagagtgtcaagaatggcatgcccggggtgggtctccttgcccgccacgccaccgccaccaagggtgtcccggccaccaacccagcccctgggaagggcactgggagtggcctcattggggccagcggggccaccatgcccaccgacacaagcaaaagtgagaagctggcttccagagcagtggcgccacccacccctgccagcaagagggactgtgtcaagggcagtgctacccccagtgggcaggagagccgcacagcccccggagaagcccgcaaggcggccacactgccagagatgagcgcaggtgaggagagtagcagctcggactccgaccccgactccgcctcgccgcccagcactggacagaacccgtcagtgtccgttcagaccagccaggactggaagcccacccgcagcctcatcgagcacgtatttgtcaccgacgtcactgccaacctcatcaccgtcacagtgaaggagtctcccaccagcgtgggcttcttcaacctgaggcattactgaagccccggcgccaccagctgcgcggtcttactccccttccctgcctatggtgtcgcttggctaagtgactcccagcccaagccccctcaagagtctgggtcgggggaggaggagtgggtggcctccttgatgggcaggcttggaagggacttctcccgcaccccactctgtcccaggacatagggcagggggcctcactgccttgttggtctccaccttgttcctacctctgcaggcctctttgctctcccctcttgcctcaggaaacccggtggcacctgtggctccaggtgactgtcttgaacagagcgggcttcttcatggctgcgttgttgctgagtttgaactgctcctccctggcctgcgtgactgaatcacagctttggtccctgtcttgcaggggctgaggtgtcaggaggggacttctggcccaccttgccttcagccctggagtgggcagagagtattgtggggaggcatggccagtgggactagtgttccctccatctggccacagcttttgggagatggggtgggcaggggtggtcctggctggcattgcctgagccggcagtgatgaagtggggagcttgcccttgacaggtgggggctggctggggccttaatgtgaaaagacagtggcaggcagctggagtagagcgagcccagcagccctaaaaggctgccttcatggccatctagccccagttcagggcagcatccatagcccacaagccagcgtgggtggggcgggggtggtcccacagctgggttccacctgaagagcctccgtgcctcggagcaggagaggcaggctatggctgccaccctccctcctgcctgtgtcccagtgagaactgacctgagtccccttccaaacccagacccacctcctgccccaggcccactgaagcatgttccatttctaaaaagcccagagttcagtgtgtcccaaggaaaacccaaagtggaggtgctcaggtccaggggagtccagtgggcaggacccttggcaggcaagcccctcccttcactcccaggacctaccttctgctagtaaaggactggcttcattctaattatggcccacagactgccccggagacctggaggacagcagtgctggcacttgggtgtccatgggcccgtctgccggctctgcctgtgctgcaagtgttggccgtgggtccagccaacaactccctacgtcctgtgtggggccctgcccaagtggatgaggcattccttgaggagtatcattttccctgacaatccccatcacctttaggggttccctgcttggctcctttccagctgaaaaactagacctgtgccattggggaagctggacaaagtctagggggcccgcctggtagagggtcccgggaagctggatctgtcagcctcggccctgaggcccctgttaactcaagactgtgagctgcctctaggtggtcacgtctgggagctagcttgtatggcttctgaccagtatcaggatttctgttctgagagcagcgtgggcagcaaggcagggcagcccagaggtggcagcggcaggcaatctggtcactaggtctttgtgatgccaaaaataaaagagggtggggtgggtgctttctgttcctctgattggatggagtccgccagcaggcatggggctacattccagtgcctgactatagggaggcactcctgattccatggagcagcccggactttgagaatgggctctggtttgcggggggcaggcgtaccagactgcaagaccccccagtacctcaccgtgccaaataggaagaggtggccttggtgtagccaaatggatctttttaacagtgtgcctttggggagggacccatgtccatggcttcgttgagggccatccatatgccagctgggggccagcccacagtggccatattggctgcagcaggaatggtgcccacctcggcgaattgaagggctaagagtcccagatagctaggccagagctggaagcagacagtaaggggaagagctgctcccacaggagagggagagattccagctcactgcgcagcctgggaggaggcgtggatcctggcacgctgagcctcaggcaccagcctccctgtgctcgacagcaaagtcttgactccttcctgctgagcactgtgctaccttcactgctccaaagccagactaacagctctccaagcccttggggtgactcggcttccaggagctgttggagaaatgaggatgtctgtccctgtctgcctgggcaggccagattcctccccagcagccgggtctctccagaccctgattcggtgcctttctgtttaccagctacttcaatcccaaagtttgaatctgcagataccttactcccagccactttgccttcttactgtgttgtgtgtttttcctggtgcttcaagagcgtgtgcagggcaagtgccgtcactgggaactgcaccagatgctcagacttggttgtcttatgtttaccaataaataaaagtagactttttctatttttatttgctgctatttgtgtgtgtgtttgtgtttgtgtagctaggtatctggcacttctgacgatgcattgttgcttttttcc

SEQ ID NO: 5862 - DNA, 4081 bp, Homo sapiens
ccgaggaaaacgttgcgcaggttcaaaaatggaacgtcggcggcgtgagggagcgcgagggggtgtgcgcgcgtgcgcgtgcgcgtgcgcgcccggacgagggtgacggggaccccgccagccccagcatcgcgcgccgcagccgcggccccgcagctccgcccccggcccggcccggccccgggcccgctcgcccgccgccccgcatggagctgtcagccatcggcgagcaggtgttcgccgtggagagcatccggaagaagcgcgtgcggaagggtaaagtcgagtatctggtgaagtggaaaggatggcccccaaagtacagcacgtgggagccagaagagcacatcttggacccccgcctcgtcatggcctacgaggagaaggaggagagagaccgagcatcggggtataggaagagaggtccgaaacccaagcggcttctgctgcagcggctgtacagcatggacctgcggagctcccacaaggccaagggcaaggagaagctctgcttctccctgacgtgcccactcggcagcgggagccctgagggggtggtcaaggcgggggcacctgagctggtggacaagggccccttggtgcccaccctgcccttcccgctccgcaagccccgaaaggcccacaagtacctgcggctctcgcgcaagaagttcccgccccgcgggcccaacctggagagccacagccatcgacgggagctcttcctgcaggagccaccggccccagacgtcctgcaggcggctggcgagtgggagcctgctgcgcagccccctgaagaggaggcagatgccgacctggccgaggggccccctccctggacacctgcgctcccctcaagtgaggtgaccgtgaccgacatcaccgccaactccatcaccgtcaccttccgcgaggcccaggcagctgagggcttcttccgagaccgcagtgggaagttctgaatcaccgtttttactcttcttaaactgttttcttttgggcttggggtgggacttccagagatagggatgggttgggggcggggtaattattttatttaaaaaaataccgagcagcaaaaggggagaagatcccactactctcccaccacctgccctttctctgagggacgtttaccacgaggcctcaggctggggatggagagagttgctctgggagttggggtaccacccccagggcaggatggggacaggatcacctgcccgggacaccaccattatcattctcctctagtgacgcagcagctggttctgggagttaaaggagcattggaaggcccaaaccctctcccttgagtggccaccccagcctggttggctggttttccccttttctcttgtttcaattgggtctttaccttgaactctcctctctggctttgcggtgggctgtggaggctggttttgaccaaaagtgagtggggcgggaggaaggggcaggaggaagggttgaggttacttggggcgagtcccttccccttcagagaggcttctatccttcccagggaggaggcgccgctgagacccttctgctgagagctctgccctcccctcatcacctggcctgtgcagaaacgctcatgcacacctggctgcacaggtgtgcacgcattacccttcgcgtgtacgttcccatgtgccccgtgaaagcatgtgtggctgcagacgtgtccacatgggccttgcgaacctgggttagaaaccctggccaggcgaacgtggggtgattcacagcacaaaagacctcaccaccacacctgcactcaccccaccttgcatgcaccttgctacctgcttgcggctttcagtggagggcaggggtctggcacaggtgcgatggcaccccatgctccaggcatacagatgtggtttctcggctgcaccgggccaggctgcgggtgtgcaggcgtctgctaagttgtgtgatgtatcagcacaggctttgagacgtctggaccctgtccttcctcccgtgaggggttcttgttctttctgactcaggtgacttttcagcccttccaattcccctctttttctgccctcccctccaactcagccaacccaggtgtgggcagtcagggagggagggagtgtcccaccacgttctcagggcagcccttgactcctaagccccttcctccttccattctgcatcccctccccatccaacctaaatgccacagctggggctgagctgtattcctgtggagggacctctgccgtgcctctctgaggtcaggctgtgctgtgtgatgggcaggctttgccccagcccacccctggcaaggtgcacttgttttctggtttgtacaaggtgtcctgggggcccgtggcttccctgccagtgaggagtgacttctccctctcttccagtcctgtaggggagacaaaaccagattggggggcccaaggggagcatggaaaaggccggctcccctgtctttccttggctgtcagagtcagggtaacacacaccaagagtggagtgcggccagcaagtttgagacctgcccgccctcctcgcagctctgctctgtgtcctcaggaagtcacagagtctactgaggcaaggagagggtgattctttccccaaatcccttcttccctggttcccaaaccaaagacagcctgcagccctttctgcatggggtgctctgttgacaggcttcccagatccctgagtctctctttccttcctcctcgatctttagttgtccacggtcaattcagtgcttccattgggggacagtcccctccgggatgacctgattcacctccagcccagggaatggaatctagaggaatacgtggggtgggtctggacaaggagcggcaggaatcaccacccatctccagctgtggagccctgtggaggggaaggggaagcttggggttcagaggggactcttccaggagaggggtgcccagcggaggtaaagatgatagagggttgtggggggtctctagttgaatgttttggcccatgactttggaacatggctggcagcttccagcagaagtcacgctccccatcccccaggggacataggacctttttcctgcttcctggtcactttcaaagaactatttgcgcaatctgtgggtctgtggattcacggggctttctgtgtgggtgctgcagttgcttttgtctgcagcagcaggacacatctttcctcttactcagccctttatggcccatggggaactccgtggctcagggagagctgaactccaggggtgtgacctgggacgggtgggcctgaggtgcccagctcagggcagccaggtggctcatgggctgtagtgagccagctccctgggggaaaaggctgtgggccgttaggaccatcctccaggacaggtgacctctatgaggtcacctacggctgtggccgtgcaggcctccttccagcccagagtggcccagtagagcaaggcagacagtgacctccacccccgcagccctcttaaaaggccagtactcttgggggtggggggagggtttagaaagcatttgcccatctgcctttctttcccccagcccccacccgctttgaatgtagagacccgtgggcacttttccttttgtggtggggggtgcggaggaggtacccccacccctggcacagccgcctggaatgcaggactgtcactgctgttcgggtgatgacctcgttgccaagctcctcctgtccccttgttctgggggcaggcgctgtgcttctgtgaggtggtttagcttttgctttcgaagtggccagctgcggccaccaggtctcagcacaagagcgcttcctttgcacagaatgagcttcgagctttgttcagactaaatgaatgtatctgggaggggtcgggggcacgagttgattccaagcacatgcctttgctgagtgtgtgtgtgctgggagagtcagagtggatgtagagcgcggttttatttttgtactgacattggtaagagactgtatagcatctatttatttagatgatttatctggtaaatgaggcaaaaaaattattaaaaatacattaaagatgatttaaaaaaaagaaaa

SEQ ID NO: 5863 - DNA, 784 bp, Homo sapiens
atggagctgtcagccatcggcgagcaggtgttcgccgtggagagcatccggaagaagcgcgtgcggaagggtaaagtcgagtatctggtgaagtggaaaggatggcccccaaagtacagcacgtgggagccagaagagcacatcttggacccccgcctcgtcatggcctacgaggagaaggaggagagagaccgagcatcggggtataggaagagaggtccgaaacccaagcggcttctgctgcaggagccaccggccccagacgtcctgcaggcggctggcgagtgggagcctgctgcgcagccccctgaagaggaggcagatgccgacctggccgaggggccccctccctggacacctgcgctcccctcaagtgaggtgaccgtgaccgacatcaccgccaactccatcaccgtcaccttccgcgaggcccaggcagctgagggcttcttccgagaccgcagtgggaagttctgaatcaccgtttttactcttcttaaactgttttcttttgggcttggggtgggacttccagagatagggatgggttgggggcggggtaattattttatttaaaaaaataccgagcagcaaaaggggagaagatcccactactctcccaccacctgccctttctctgagggacgtttaccacgaggcctcaggctggggatggagagagttgctctgggagttggggtaccacccccagggcaggatggggacaggatcacctgcccgggacaccaccattatcattctcctctagtgacgcagcagctgg

SEQ ID NO: 5864 - DNA, 472 bp, Homo sapiens
gagggtgacggggaccccgccagccccagcatcgcgcgccgcagccgcggccccgcagctccgcccccggcccggcccggccccgggcccgctcgcccgccgccccgcatggagctgtcagccatcggcgagcaggtgttcgccgtggagagcatccggaagaagcgcgtgcggaagggtaaagtcgagtatctggtgaagtggaaaggatggcccccaaaggaggagagagaccgagcatcggggtataggaagagaggtccgaaacccaagcggcttctgctgcagcggctgtacagcatggacctgcggagctcccacaaggccaagggcaaggagaagctctgcttctccctgacgtgcccactcggcagcgggagccctgagggggtggtcaaggcgggggcacctgagctggtggacaagggccccttggtgcccaccctgcccttcccgctccgcaagccccgaa

SEQ ID NO: 5865 - DNA, 5918 bp, Homo sapiens
aggtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgagttttggaaatctagtcctagtattctggccgttcagagatctgcaatcctcaagaagcagcaacagcagcagcagcaacaacaacatcaagcctcatctaatagcggatcagaagaggattcctctagcagtgaagattccgatgactcatcaagtgaggtcaaaaggaaaaagcataaagatgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaatagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggagctactggtgctactacaaccatctatgcagttgaagcagatggtgacccaaatgcaggctttgaaaaaaacaaagaaccaggagagattcagtatttaattaaatggaaaggatggtcccatatccacaacacttgggagacagaagaaaccctcaagcagcagaatgttagaggaatgaaaaaattggataattataagaaaaaagatcaggaaacaaaaagatggttgaaaaatgcctctccagaagatgtggaatattataattgccagcaagaacttacagatgatctacataaacagtatcaaatagtggaacgtataattgctcattccaatcaaaagtcagcagctggttatcctgattattactgcaaatggcagggccttccatactcagagtgcagctgggaagatggagctctcatttccaaaaagtttcaagcatgcattgatgagtattttagcaggaaccaatcaaaaaccactccttttaaagattgcaaagtattaaaacaaaggccaaggtttgtagccctgaagaagcagccatcctatattggaggacatgagggcttagaattaagagattatcaactgaatggtttaaattggcttgctcattcttggtgcaaaggaaatagttgcatactcgctgatgaaatgggccttggaaaaacaatacagacgatctcatttctgaattatttgtttcatgaacatcaattatatggaccttttttattggtagtaccgctctccactcttacttcctggcaaagggaaattcagacttgggcttctcaaatgaatgctgtggtttatttaggtgacattaacagcagaaacatgataagaactcatgaatggacgcatcatcagaccaaacggttaaaatttaatatattgttaacaacttatgaaattttattaaaagataaggcattccttggaggtctaaattgggcatttataggtgttgatgaagcacaccgattaaagaatgatgactcccttctgtataaaactttaatagattttaaatccaatcatcgtctccttatcactggaactcctctacagaattccctcaaagagctctggtctttgctacatttcattatgccagaaaagttttcttcctgggaagattttgaagaagaacatggcaaagggagagaatatggttatgcaagccttcacaaggagcttgagccatttctgttacgccgagttaagaaagatgtggaaaaatctcttcctgccaaggttgagcagattttaagaatggaaatgagtgctttacagaaacaatattacaaatggattttaactaggaattacaaagccctcagcaaaggttccaagggcagtacctcaggctttttgaacattatgatggagctaaagaaatgttgtaaccattgctacctcattaaaccaccagataataatgaattctataataaacaggaggccttacaacacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaaagattagatggatcaataaaaggagaactgaggaaacaagctctagatcattttaatgctgagggatcagaggatttttgctttttgctgtccacaagagctggaggtctagggattaatttagcctctgctgacactgttgttatatttgattccgattggaatccacagaatgatcttcaggcacaggctagagcccatcgaattgggcaaaagaaacaggtgaatatttatcgtctagttacaaagggatcagttgaagaagatattcttgaaagggcgaaaaagaagatggttttagatcatcttgtaattcaaagaatggacacaactgggaagacagtactacatacaggttctgccccatcaagttctactcctttcaataaagaagagttatcagccattttaaagtttggtgctgaagaactttttaaggaacctgaaggagaagaacaagagccccaggaaatggatatagatgaaatcttgaagagagctgaaactcatgaaaatgaaccaggtcctttaactgtaggagatgaattgctttcccagttcaaggttgccaacttctcaaatatggatgaggatgacattgagttggaacctgaaagaaattcaaagaattgggaggaaattattccagaagatcaaagaagacgattagaagaagaagaaagacaaaaggaacttgaagaaatttatatgctcccaagaatgagaaattgtgcaaaacagattagtttcaatggaagtgaagggaggcgcagtagaagtaggagatactctggatctgatagtgattccatctcagaagggaaaaggccaaagaaacgtggaagaccacggactattcctcgggagaatattaaaggatttagtgatgcagaaattaggcggtttatcaagagctataagaaatttggtggtcctctggaaagattagatgcaattgctcgagatgctgagttagttgataagtcagaaacagaccttagacgactgggagaattggtacataatggttgcattaaagcattaaaggatagttcttcaggaacagaacgaacaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtatactatcccatgccacacaaaggcagctcattttgatatagactggggcaaagaagatgattccaatttgttaattggcatctatgaatatggatatggaagctgggaaatgattaaaatggatcctgacctcagtctaacacacaagattcttccagatgatcccgataaaaaaccacaagcaaaacagttgcagacccgtgcagactacctcatcaaattacttagtagagatcttgcaaaaaaagaagctctttctggtgcgggaagttcaaagaggagaaaagcaagagctaagaagaataaagcaatgaagtctataaaagtgaaagaggaaataaagagtgattcttctcctctgccttcagagaagtctgatgaagatgatgataaattgagtgaatccaagtctgatggtagggaaagatccaagaaatcttcagtgtcagatgctccagttcatatcacggcaagtggtgaaccagttcccatttctgaagaatctgaagagctggatcagaagacattcagcatttgtaaagaaagaatgaggcctgttaaagcagctttgaaacaacttgataggcctgagaaaggcctttcagaaagagaacaactagagcatactagacaatgtttaataaaaattggagaccatatcacagaatgtctaaaagagtatacaaatcctgaacaaattaagcaatggagaaaaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttac

SEQ ID NO: 5866 - DNA, 1985 bp, Homo sapiens
tatttaaggtatacaatttgatgatttgatatacacatgcattgtgaaataattacagtctctgattaattactgatgcctcccttgggatgggaagagatagcaaactgtacctcatttatggtgtttggttgtgttactcttgggaccattacattaccattattaagtgacagttaactttttaatgcattatttaagacaattctttacaagcataattcatattatctgatggtatttccactccagttattaacatacctgtcccttatatgcataatcaggatcacaatatgaatctgagtcacttcctgatttaatttatgtctttggtgcatttcaaattaggattgtactgcttttcaccctaaagactataaaatgaagcgatttggaagagaagtaaaatttaatgtttagtttcactggagtcttagtcatatatgaagttttgaaaaaatgcataggaaaattaatatccttaagagtttgttccatagagggctgtgtatgtgtatatgtgtttgtgcctggagggaaggagttccatgaaaaactaaatattttccaccagactaacttaatttgcctttttttaaattcttctagaaacctgtggatttttgtatctaagtttactgaatttgatgcaagaaaattacataaattatataagcatgctattaaaaaacggcaggagtctcagcaaaacagtgatcaaaacagcaacttgaatcctcacgtgattagaaatccagatgtggaaagattaaaagagaatacaaatcacgatgatagcagcagggacagttattcctctgatagacacttaactcagtaccatgatcatcataaagaccgacatcagggagattcttacaaaaaaagtgattccaggaaaagaccctattcttcttttagtaatggtaaagaccatcgtgattgggatcactacaagcaagacagcagatattacagtgacagagagaaacacagaaaactggatgatcacaggagtagagatcacaggtcaaatttggaaggaagtttaaaagatagatctcattctgatcatcgttctcactcagatcatcggttacattcagaccaccggtcaagttctgaatatacgcaccataaatcttccagggattataggtatcactcagactggcaaatggaccacagagcttccagcagtggccctaggtcaccactagatcagagatctccttatggctccagatctccatttgaacattcagttgaacacaaaagtacaccggagcatacctggagtagtcggaaaacataacaaaaactgatacttcgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttcctttccctaccaactcaggccttcttatt

SEQ ID NO: 5867 - DNA, 771 bp, Homo sapiens
aggtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaagccagtcggatgatgattctgggtcagcttcaggctctggatctggttcgagttctggaagcagtagtgatggaagcagtagccagtcaggtagcagtgactctgactccggatctgaatcaggcagtcagtcagagtctgagtcagacacttcccgagaaaacaaagttcaagcaaaaccaccgaaagttgatggagctgagttttggaaatctagtcctagtattctggccgttcagagatctgcaatcctcaagaagcagcaacagcagcagcagcaacaacaacatcaagcctcatctaatagcggatcagaagaggattcctctagcagtgaagattccgatgactcatcaagtgaggtcaaaaggaaaaagcataaagatgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaatagatctaagtcaaaaaatgaaaaaaaaaaaaaaaaa

SEQ ID NO: 5868 - DNA, 1144 bp, Homo sapiens
gctactagccgcgggggccaagcgcctggcttcttactgcggcttcatactgagggccgagccgaggcggcgcgggtgcaggagcaggacttacggcagtgggggctgacagggattcacctacgctcttaccagctggagggagtaactggctcgcccagcgcttccattgtcagaatggctgtatcctgggagatgagatgggcctggggaagacctgccagactattgctctcttcatttatttggcaggaagattaaatgatgaagggccatttctgattctttgtcccttgtctgttgagcaactggaaagaagaaatgcagagatttgctccaggtctttcctgtgtaacatatgcggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagagtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggtgac

SEQ ID NO: 5869 - DNA, 2413 bp, Homo sapiens
ggagcgcgcgggcgctactagccgcgggggccaagcgcctggcttcttactgcggcttcatactgagggccgagccgaggcggcgcgggtgcaggagcaggacttacggcagtgggggctgacagattcccttggagtgttcttgttgtggatgaagctcacaggttgaaaaaccaaagctccctgctgcataagaccttgtcagagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatactgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcatgcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcaatttggttctcctggatgttttgctctgttttggtacctgtaatatagggaaacacaactttttttgggaaagccctttgaccccagcttgctagttgcataataataaattttctgttcct

SEQ ID NO: 5870 - DNA, 2967 bp, Homo sapiens
gcggggcctctaccggcccgatggagcgcgcgggcgctactagccgcgggggccaagcgcctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccagactattgctctcttcatttatttggcaggaagattaaatgatgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatactgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcatgcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcaatttggttctcctggatgttttgctctgttttggtacctgtaatatagggaaacacaactttttttgggaaagccctttgaccccagcttgctagttgcataataataaattttctgttcctaa

SEQ ID NO: 5871 - DNA, 2396 bp, Homo sapiens
gcgttgggaagttgggagggaggtgcgcgcttggccgcgcggggcggggcctctaccggcccgatggagcgcgcgggcgctactagccgcgggggccaagcgcctggcttcttactgcggcttcatactgagggccgagccgaggcggcgcgggtgcaggagcaggacttacggcagtgggggctgacagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatactgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcatgcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcaatttggttctcctggatgttttgctctgttttggtacctgtaatatagggaaacacaactttttttgggaaagccctttgaccccagcttgctagttgcataataataaattttctgttcct

SEQ ID NO: 5872 - DNA, 2726 bp, Homo sapiens
gcgttgggaagttgggagggaggtgcgcgcttggccgcgcggggcggggcctctaccggcccgatggagcgcgcgggcgctactagccgcgggggccaagcgcctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccagactattgctctcttcatttatttggcaggaagattaaatgatgaagggccatttctgattctttgtcccttgtctgttttgagcaactggaaagaagaaatgcagagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccagttgagtgagatactcaaatttggtttggataaactgctggcctctgaggggagcaccatggatgaaatagacctggagtccatactgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcatgcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcaatttggttctcctggatgttttgctctgttttggtacctgtaatatagggaaacacaactttttttgggaaagccctttgaccccagcttgctagttgcataataataaattttctgttcct

SEQ ID NO: 5873 - DNA, 2837 bp, Homo sapiens
ccgatggagcgcgcgggcgctactagccgcgggggccaagcgcctggcttcttactgcggcttcatactgagggccgagccgaggcggcgcgggtgcaggagcaggacttacggcagtgggggctgacagggattcacctacgctcttaccagctggagggagtaaactggctcgcccagcgcttccattgtcagaatggctgtatcctgggagatgagatgggcctggggaagacctgccagatttgctccaggtctttcctgtgtaacatatgcaggcgacaaggaggaaagagcctgccttcagcaagacctgaaacaggagtcacgttttcatgtgctactgactacctatgagatttgcttgaaagatgcatcatttctaaaatcattcccttggagtgttcttgttgtggatgaagctcacaggttgaaaaaccaaagctccctgctgcataagaccttgtcagagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctagatgcatttgaaaatgagacggcaaagaaagttaaactacagaacattttgtcccagcttcgaaagtgtgtggatcacccatatttgtttgatggtgtggagccggagccttttgaagttggagaccacctgactgaggctagtgggaagcttcacctgctggataagctactagcattcctgtattctgggggccatcgggttttacttttctcccaaatgacccagatgttggatattctccaagactatatggattacagaggctacagctatgagcgtgtggatggttctgtgagaggagaagagagacacttggccattaagaactttggacagcagcccattttcgtttttctcctgagtactagggcaggtggagttggcatgaacttaacagcagcagatactgtgatttttgttgacagtgactttaatcctcagaatgacttgcaagcagctgccagggctcatcgcattggccaaaacaagtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccaggtgagatactcaaatttggtttggataaactgctggcctctgaggggagcaccatggatgaaatagacctggagtccatactgggagaaacaaaagatggccagtgggtctctgatgccttgcctgcagcagaaggagggagcagagatcaagaggaaggaaaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtagatgactctggccactggggcagaggtggtttatttacagctctggaaaagcgatccgctgagccaagaaaaatatatgagctggctgggaaaatgaaagacctgagtttgggaggtgtccttttatttcctgttgatgataaagaatcaagaaacaaagggcaagatttgttggccttgattgtggctcagcatcgtgatcgttccaatgtcctgtctggcattaagatggcagccctagaagagggcctgaagaagatatttttagcagcaaaaaagaagaaagcaagtgttcatcttccacgtattggacatgccacgaaaggttttaactggtatggtactgagcgacttattcggaaacatctggctgcaagaggcatcccaacttacatatattattttcctagaagcaagtctgctgtccttcatgcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcaatttggttctcctggatgttttgctctgttttggtacctgtaatatagggaaacacaactttttttgggaaagccctttgaccccagcttgctagttgcataataataaattttctgttcct

SEQ ID NO: 5874 - DNA, 9857 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagaaaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcaaaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggcaccatcatgactccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgcaccctgcagtctcagatcctcgctcacccccttctcagaaatctcctcacgattccaagtcacccctggatcataggtctcctttggagagatcactagaacagaaaaacaacccagattataactggaatgttcggaaaacataaaggacagctcgtaaaggagagagtaagagtcaccaaacacgtggatatttttggtctgatcctacagtagccggttatctagaccagtaagtggagttttggacatgctgctgctgtcaactcactggctgaaggagcacttcaaggaatgggaggcctttcactgggtccagctctgattcgggtcaccactcctgcactttggcaccccatcccattccagcctagttctggcctcccactttgacgggcacttggaggaggagctgactgtgtgtgtaccagcttcactgggatgtgtttccccagtcaaggaacaggggatcttcagagtcatgaatgttttcttgccagggtcagtgttcccaggaccttagtgcatggtcggggcaggaactggtgcatggaggctgctgggacctggtgaacagtgtgtgatttggttgatttggttcactctgacatgatggatgctgctgatggggagtggcgagttggggcaagcgggtggggacaagcataggacttgaaggggagcaggtacacccctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgggcctccttttcccactgtgccagggaaggtaggtttctctggctgactgagtactgtgagtgaggcaacactgatgccagcatgggtcttacttgactggggagtaggctgagtgaggggtagggtggggtaggtggggagtagtgtggccagggaactggaatccctggtggatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtattgcgctaggtcaacacttcctgctgcatttccttccctttgcacagcttgaagaaatagagtagacagaatcacacatcatgtggtgggcagatggaaataagtacctgtggtgaacaagtttctactgtagttggagatcattagaattgaattcagtttctcttagaatataatcaggtataaacctaagttaaactttttcccaaacaaggagcatccaaagacacagtgacttgagctatagatagtaaaaatcatacgagagttgaactgagtcaggtttaggaagcaagtttggttgcatcaattaagcaggctcttttcaattgactgatgctggggccttcagttttattctcagtatagattgccagtattgttaagagtatccaaaggcctttctagatggagacagaataactgacttgaacatacagtgtgcctgtaagtgtccaggctcagagctggtgaaaacccttctgttgggcgtgtgcagggttaaactcctgaagtaacttgtgaggacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctgccgtgacgctcagtggagagggcagggcctgtgtctccacttaggccacacagtgatgaggaaaccacagatggagcttcttgccgataatactgactctagcccatgattgccttgcccaagccaaagaggaaggttaggttggcttgtcgagcccttgagcgttgggagatggggtgggaaggaggtgagcccctgcagagagttgggtagtgtccttcaggaatgaaaggaggggcaaaggagtcaccagaggtcctgcatttccatcagggtttccacagtcatcagggcttctctcttgagttgctgataggagatgtgagttatgcccagagatgtcttatcgtgaggaaaaagaaacttccttttgttcacatttaggactctcagtgccatatgaagtagcaaaaggcagtatcggccagatcagtgttacattgattctaaaattacagtgtccccattagacaactattttaggtgctggagtatgtttgaagagtgtgctgggaaaaaggaagcatttcttcattgatttaaatcagtatgaatattatatgcctaaataaaaaatttgcacaggtaaattctctcacttgtgaatgggagaagctgccccaggaatctgtgaggatggtattccctggagtctggctttgaaagatttcattgttggtagaaataacaggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaactgctgtacttttgattcttgtatattaaaaagtgttactgagcatttttagaattgggctaaca

SEQ ID NO: 5875 - DNA, 2221 bp, Homo sapiens
ggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaagtaggtagaaaaatatgagtgcaattttccttactgtttctggcttctttattgttagatgtcaagaattttttttttcttttttcacacccttattgtatctcaaccaagaaatctttatgctgcatattacagaaataaaagatgattgagagaaa

SEQ ID NO: 5876 - DNA, 2131 bp, Homo sapiens
agggagccgcacgccgaggggaaaaggaagggaactctagttgggactttccggtgggcggcttctttcctggacgcgtttgctcctggcagtcttgtccgcccttgcctgtagcggtccgcaccctgtagtgtgttcttttgcccatttccgggaatggtttatcctctttgagaagcggctgcttttggagaaaaagtgcaggcactatttataaattttaaaggcactatttggaaatcttaaaatagaaaatttgcccagttttacattttcccttttcataccttagcgtcccttctccccgcccccgttcagtgtgaagagatgagtgggtttaattttgttacaattgaccaaaacgtttgagtgtcagaggcggatacttttattttagtgaaaacctcttgacgggtgttaacagctgtttaatacatggctcataaacaaagggaagattatttgaacttgtccccatgcgtttttacttggtaccgtacattttctcagttggcatttgatggagaaaaactcagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaagtaggtagaaaaatatgagtgcaattttccttactgtttctggcttctttattgttagatgtcaagaattttttttttcttttttcacacccttattgtatctcaaccaagaaatctttatgctgcatattacagaaataaaagatgattgagag

SEQ ID NO: 5877 - DNA, 1095 bp, Homo sapiens
ctcttctcgcactgcccctccgtggtcgggggccggctctcgccggcgggatgcgcctcggtgccctgggcccgagtcgtagggtcctggggtagggggcacgcggggccccgctgcagagcccgcgggcggcaggtgggcggggggcagcctcgtcgccgggactggatccgccgggaaaggggcggcgggtgaatgccggcgagagcccgaaggggatcgggcgtggagagcccctttctgtcctggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttataaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaag

SEQ ID NO: 5878 - DNA, 7764 bp, Homo sapiens
ccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagaaaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcaaaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttgtgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccgaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttgg

SEQ ID NO: 5879 - DNA, 7328 bp, Homo sapiens
atatggaggtgaagggtgagatcgggaaacaaagggtatggccccctagttcccaaagggagcagggagatgggaatagaattgaaggtaggttttaggctacttgggaggaggaatatttaggtaattgtggagactttctcctgtgtgatgaaggcggcagacactgtgatcctgtgggcaagaagtaaaaatgaccagctgaggatttcttttcctccaggactgtgttggggtgacaggatgcctgataaggatgacattcggctgctgccgtcagcattgggtgtgaagaagagaaaacgaggacccaagaagcagaaggagaacaagccaggaaaaccccgaaaacgcaagaagcgtgacagtgaggaggaatttggttctgagcgagatgagtaccgggagaagtcagagagtgggggcagtgaatatggaaccggaccgggtcggaaacgaagaaggaagcaccgagaaaaaaaggagaagaagacaaagcggcggaaaaagggggagggagatggggggcaaaagcaagtggaacagaagtcatcagcaactctgcttctgacctggggcctggaggatgtggagcatgtgttctctgaggaggattaccacacgctcaccaactacaaagccttcagccagttcatgaggcccctaattgctaagaagaatcctaagatcccaatgtctaagatgatgaccatccttggggccaaatggagagagttcagtgccaacaaccccttcaaggggtcagcagctgctgtggcggcggcagcggcagcagcagcagcagctgtagctgagcaggtgtcagctgctgtctcgtcggccacccccatagcaccctccggaccccccgcccttccaccaccccctgctgctgatatccagcccccacccatccgaagagccaaaaccaaagagggcaaaggtccaggccataagaggcggagtaagagcccccgagtgcctgatggacgcaagaagcttcggggaaagaaaatggcaccactcaaaataaaactagggcttctgggtggcaagaggaagaaaggaggctcgtatgtttttcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaaggtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacatgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacagtgtggataaaaaggggaattaccactatctagtaaaatggagggacttaccatatgaccagtccacgtgggaggaagatgaaatgaatatccctgaatacgaagaacataagcaaagctactggagacaccgagaactaattatgggggaagaccctgcccagccccgcaagtataagaagaagaagaaggagctacagggtgatgggcctcccagttctcccactaatgatcctaccgtgaaatatgagactcagccacggtttatcacagccactggaggcaccctgcacatgtatcagttggaagggctgaactggctacgcttctcctgggcccagggcactgacaccattctagctgatgagatggggctaggcaagaccatacaaaccatcgtcttcctctactcactctacaaggagggccacacaaaaggtcccttcctggtgagtgccccactctctaccatcattaactgggagcgggagttccagatgtgggcacccaaattctatgtggtgacatacacgggtgacaaggacagccgggccatcattcgtgagaatgaattctcctttgaggacaatgccatcaaagggggcaagaaagcttttaagatgaagagggaggcacaggtgaagttccatgttctcctgacatcgtatgagctgatcaccattgatcaggcagcacttggttccatccgctgggcctgtcttgtggtagatgaggcccatcgactcaagaacaaccagtccaagtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctttctgtgt

SEQ ID NO: 5880 - DNA, 7286 bp, Homo sapiens
atctttgtttgggtctcccatactgcgtatagatgaatgggtcaggatatctggaacaaaatatggaggtgaagggtgagatcgggaaacaaagggtatggccccctagttcccaaagggagcagggagatgggaatagaattgaaggtaggttttaggctacttgggaggaggaatatttaggtaattgtggagactttctcctgtgtgatgaaggcggcagacactgtgatcctgtgggcaagaagtaaaaatgaccagctgaggatttcttttcctccaggactgtgttggggtgacaggatgcctgataaggatgacattcggctgctgccgtcagcattgggtgtgaagaagagaaaacgaggacccaagaagcagaaggagaacaagccaggaaaaccccgaaaacgcaagaagcgtgacagtgaggaggaatttggttctgagcgagatgagtaccgggagaagtcagagagtgggggcagtgaatatggaaccggaccgggtcggaaacgaagaaggaagcaccgagaaaaaaaggagaagaagacaaagcggcggaaaaagggggagggagatggggggcaaaagcaagtggaacagaagtcatcagcaactctgcttctgacctggggcctggaggatgtggagcatgtgttctctgaggaggattaccacacgctcaccaactacaaagccttcagccagttcatgaggcccctaattgctaagaagaatcctaagatcccaatgtctaagatgatgaccatccttggggccaaatggagagagttcagtgccaacaaccccttcaaggggtcagcagctgctgtggcggcggcagcggcagcagcagcagcagctgtagctgagcaggtgtcagctgctgtctcgtcggccacccccatagcaccctccggaccccccgcccttccaccaccccctgctgctgatatccagcccccacccatccgaagagccaaaaccaaagagggcaaaggtccaggccataagaggcggagtaagagcccccgagtgcctgatggacgcaagaagcttcggggaaagaaaatggcaccactcaaaataaaactagggcttctgggtggcaagaggaagaaaggaggctcgtatgtttttcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaaggtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacatgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacagtgtggataaaaaggggaattaccactatctagtaaaatggagggacttaccatatgaccagtccacgtgggaggaagatgaaatgaatatccctgaatacgaagaacataagcaaagctactggagacaccgagaactaattatgggggaagaccctgcccagccccgcaagtataagaagaagaagaaggagctacagggtgatgggcctcccagttctcccactaatgatcctaccgtgaaatatgagactcagccacggtttatcacagccactggaggcaccctgcacatgtatcagttggaagggctgaactggctacgcttctcctgggcccagggcactgacaccattctagctgatgagatggggctaggcaagaccatacaaaccatcgtcttcctctactcactctacaaggagggccacacaaaaggtcccttcctggtgagtgccccactctctaccatcattaactgggagcgggagttccagatgtgggcacccaaattctatgtggtgacatacacgggtgacaaggacagccgggccatcattcgtgagaatgaattctcctttgaggacaatgccatcaaagggggcaagaaagcttttaagatgaagagggaggcacaggtgaagttccatgttctcctgacatcgtatgagctgatcaccattgatcaggcagcacttggttccatccgctgggcctgtcttgtggtagatgaggcccatcgactcaagaacaaccagtccaagtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctttctgtgt

SEQ ID NO: 5881 - DNA, 7356 bp, Homo sapiens
gatggcttcccctctgagggacgaggaggaggaggaggaggagatggtggtgtcggaggaggaagaagaggaggaagaagagggcgacgaggaggaggaggaggaggtggaggcggccgacgaggacgatgaggaggacgacgacgagggagtactcgggcgcgggccgggccacgaccggggccgcgaccgccacagcccccccggctgccacctcttcccgccgccgccgccgccgccgccaccgctgcccccgccgccgccgcccccgccgccagataaggatgacattcggctgctgccgtcagcattgggtgtgaagaagagaaaacgaggacccaagaagcagaaggagaacaagccaggaaaaccccgaaaacgcaagaagcgtgacagtgaggaggaatttggttctgagcgagatgagtaccgggagaagtcagagagtgggggcagtgaatatggaaccggaccgggtcggaaacgaagaaggaagcaccgagaaaaaaaggagaagaagacaaagcggcggaaaaagggggagggagatggggggcaaaagcaagtggaacagaagtcatcagcaactctgcttctgacctggggcctggaggatgtggagcatgtgttctctgaggaggattaccacacgctcaccaactacaaagccttcagccagttcatgaggcccctaattgctaagaagaatcctaagatcccaatgtctaagatgatgaccatccttggggccaaatggagagagttcagtgccaacaaccccttcaaggggtcagcagctgctgtggcggcggcagcggcagcagcagcagcagctgtagctgagcaggtgtcagctgctgtctcgtcggccacccccatagcaccctccggaccccccgcccttccaccaccccctgctgctgatatccagcccccacccatccgaagagccaaaaccaaagagggcaaaggtccaggccataagaggcggagtaagagcccccgagtgcctgatggacgcaagaagcttcggggaaagaaaatggcaccactcaaaataaaactagggcttctgggtggcaagaggaagaaaggaggctcgtatgtttttcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaaggtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacatgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacagtgtggataaaaaggggaattaccactatctagtaaaatggagggacttaccatatgaccagtccacgtgggaggaagatgaaatgaatatccctgaatacgaagaacataagcaaagctactggagacaccgagaactaattatgggggaagaccctgcccagccccgcaagtataagaagaagaagaaggagctacagggtgatgggcctcccagttctcccactaatgatcctaccgtgaaatatgagactcagccacggtttatcacagccactggaggcaccctgcacatgtatcagttggaagggctgaactggctacgcttctcctgggcccagggcactgacaccattctagctgatgagatggggctaggcaagaccatacaaaccatcgtcttcctctactcactctacaaggagggccacacaaaaggtcccttcctggtgagtgccccactctctaccatcattaactgggagcgggagttccagatgtgggcacccaaattctatgtggtgacatacacgggtgacaaggacagccgggccatcattcgtgagaatgaattctcctttgaggacaatgccatcaaagggggcaagaaagcttttaagatgaagagggaggcacaggtgaagttccatgttctcctgacatcgtatgagctgatcaccattgatcaggcagcacttggttccatccgctgggcctgtcttgtggtagatgaggcccatcgactcaagaacaaccagtccaagtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctttctgtgt

SEQ ID NO: 5882 - DNA, 9646 bp, Homo sapiens
tcgcccgccgcgcgcgccggtccggcagcgcacgggttaaggctggcaccgcgcccggcgggagggggggcgcccacctcccctcctccccgcgccgggcatgcggggcccagtgggcaccgaggaggagctgccgcggctgttcgccgaggagatggagaatgaggacgagatgtcagaagaagaagatggtggtcttgaagccttcgatgactttttccctgtggagcccgtgagccttcctaagaagaagaaacccaagaagctcaaggaaaacaagtgtaaagggaagcggaagaagaaagaggggagcaatgatgagctatcagagaatgaagaggatctggaagagaagtcggagagtgaaggcagtgactactccccgaataaaaagaagaagaagaaactcaaggacaagaaggagaaaaaagccaagcgaaaaaagaaggatgaggatgaggatgataatgatgatggatgcttaaaggagcccaagtcctcggggcagctcatggccgagtggggcctggacgacgtggactacctgttctcggaggaggattaccacacgctgaccaactacaaggccttcagccagttcctcaggccactcattgccaagaagaacccgaagatccccatgtccaaaatgatgaccgtcctgggtgccaagtggcgggagttcagcgccaacaaccccttcaagggcagctccgcggcagcagcggcggcggcggtggctgcggctgtagagacggtcaccatctcccctccgctagccgtcagccccccgcaggtgccccagcctgtgcctatccgcaaggccaagaccaaggagggcaaagggcctggagtgaggaagaagatcaaaggctccaaagatgggaagaaaaagggcaaagggaaaaagacggccgggctcaagttccgcttcggggggatcagcaacaagaggaagaaaggctcctcgagtgaagaagatgagagggaggagtcggacttcgacagcgccagcatccacagtgcctccgtgcgctccgaatgctctgcagccctgggcaagaagagcaagaggaggcgcaagaagaagaggattgatgatggtgacggctatgagacagaccaccaggattactgtgaggtgtgccagcagggtggggagatcatcctgtgcgacacctgcccgagggcctaccatctcgtatgcctggacccagagctggagaaggctcccgagggcaagtggagctgcccccactgtgagaaggaggggatccagtgggagccgaaggacgacgacgatgaagaggaggagggcggctgcgaggaggaggaggacgaccacatggagttctgccgcgtgtgcaaggacgggggcgagctgctctgctgcgacgcctgcccctcctcctaccacctgcattgcctcaacccgccgctgcccgagatcccaaacggtgaatggctctgcccgcgctgtacttgccccccactgaagggcaaagtccagcggattctacactggaggtggacggagccccctgcccccttcatggtggggctgccggggcctgacgtggagcccagcctccctccacctaagcccctggagggcatccctgagagagagttctttgtcaagtgggcagggctgtcctactggcattgctcctgggtgaaggagctacagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccattgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagtcgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagggcgctttcggctcctcccagatgtacagcaacaactttgggcccaacttccggggccctggaccgggagggattgtcaactacaaccagatgcccctggggccctatgtgaccgatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcgaacctgcagcactgatgtctctttaccgatgggttccagacccaaggtagtcctggcactgccctgtggactcagcccagctggggaggacatggcgcccggtgccctaggagccctcagtgtcccctacctgacctgtctgcacctgtgtgacagccccttctgatttggccccctgcccgcttggagcctcccagcaccagacagggcaggtttggggagccgctgtccagccctatggtgagaccctggctgacatttcccctccttcctgccaaggctggaggccgccaggtgtttgctctctccttgtggggaggtggatcctctgccagcaggtgtctgtccccggcccagcgcatcttgaaggccctggactctgttaccagtggggggcctgtggccccggctcttcacagcaggcagaagcgtatgatcccagggagggtgggctggggggggggcagcacttgcctcggagccactgctgcgttgggtttgccttctgccagaggtgtggttaagggcagtgatagctgcgccccagcaaggagggtcatgggccctgagctggcccaggagaccctggccctgccctgtgccctgggatgcctaccctgcccacctccggaggtggaaccgggctgcccctgggggcctggacttgtcccattcccctgtccctggaaaggccttcccgggggctttttgcctgaggctgcactcttggaaggcgtggggagagttctgcctggagggggactggacccagtgccctctgcagacccctcccagccgcagcaccaagggcttgctgccttgtttcctgccaggagcgccctgacatcccaaaaccatcttcccacatgtgggttgttggaatcccacccactcccccggaccctgcccctccaagttggggacggagatggggagcaggtcaggccctccctaggcctgtttgtgtgtgatccttctcctggccccaggtcgacctggaaggcgtttctgagtcttgtactgggaccttcccagggaaggtgccttggggtgcagaatcctgggaatgttaggaaagggctgcgtgaaaaacccagctgggcctggggtggaggtgcacacgggctggggctcagctccttggagagggcctgcctgggactgagggggccagggctgggtcaggattcaccagcttgtgttgcagacactggagcgattgcctggccctccctaagccctatatgcctcactcataatgaggctgtctctgaaccccggagggcgggacctacaagtccttcctcttggcgcattcccacactccagtctggatccaggtctgcaaggccagcccgaccctgacactgcacgtgggcgtagtggggagcaccctggagtggagatgattgtcagcgggctcacatgttatggttcatccacatgcgtgttgtgtgctctgcggtgcctcctggcaaagggtcctggctcgggtcagaagctcactcccgtgccctcgtccccaaacaagcagtggcaagcactggggttggccctcgttgggagcagtgcccaccttccttggcccacagcagataggtcccgagcagcaggactggaggcctgtggcggtcagggcaggggtctgtgtctccaccccaagggctgatggtccctcccctgtgcgccttcctctcaggcaggcttgctctgtcccttcctctctgcttccctcccaggcctcgccagggctcccttctcctctgcctggttagactcgggcacccaggaaagcctggccagggctcctttgggcctgggccccctgcactgcctggtccagaaggggtggtgctgtccgtggccagcaccccggggcccgggaggggtgggctactagagtcagagcgggtttggggctgaccagtttgggagaggagaaaagatctgagaatgtccttcttggtttgtcagtcatctctgccaaaagtggtgatggtggtgtccgtatgtttggcgtctttgggctgggtttggtttttgctgctggtagaatcagggtcctcgggcatgaacgcgagcccaaagtgccagtctgcgattggaaatttccagccactttaagccagtgctgagtagggcttctgcagagccatgtttgagccaaggtcttggaaggcattgccccatgggctcaggtgactcggggtggagtgagcacgtctgcagggccctctcatacacgcctgaggcagaagcagcgtcccccgtgaaagccaccttccgaagctcctgcgttttttgcaaacttggcttcccccaggggcaggctggactttccctgccccctatgattgaagtcctcctgcttttgggggctgccttcccagagtcccccgggtgctcccctgccgaggtcaggagctgaccaagccttggcccggtgacacctgcagccctcactcctgtcatcccaggacacttgaggcccaaggaggtggagtggagagtgggctcgggtacatgggagccagaagccagatggacttggtcaagtgtcggtcacttggagcctccagtgtgcgtcagggtctgtgggcaggggacagggcgtgggtgggggccgaggctggcacgcccctctgccctcaccgtcttggtgacctggcctcggcccctcccccaagtctcttctgtgcaaggcccgcctcggcctcggcagctggttcctgtcctgttttctgtgtctgaaagtttacaggttgtggtgcatcagcccaaactcactggcgttgtgttttttttttctttaattttcagattttttttttaaacaaagtatttttttaggtgcgataacccagaaagggcccgttgggtgtgtgtgtgtgtcctgaactcctcaagcagcgattggagcccaagcacccctggagaggaagggagggtccccactggcccgtggggtctgagttcaggggtgtggagggagcagactccaccggcccaggcccagctaagagggggccgacccctttccccaggcacagccccaggctggcaaagggagggccctgggctgggtgcaaggcgcgccaggagtcccagccagggtggccccggcgggggcgggtccagctttggaagccaggctcccctgtgagccgtggcttgtctggtcttcgcccacgggaggctggacagaggctgtagccaacacaatcacctttactttgtactctgtgtgtatgttttggttttctgtgttttaataaatcctttgggaaagg

SEQ ID NO: 5883 - DNA, 3044 bp, Homo sapiens
atgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggtctgtgctgctgccgcccaccaccctcccagggggcctctcatcccgggcctcaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagtcgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcg

SEQ ID NO: 5884 - DNA, 3754 bp, Homo sapiens
attctacactggaggtggacggagccccctgcccccttcatggtggggctgccggggcctgacgtggagcccagcctccctccacctaagcccctggagggcatccctgagagagagttctttgtcaagtgggcagggctgtcctactggcattgctcctgggtgaaggagctacagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccattgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagtcgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagagcagactccaccggcccaggcccagctaagagggggccgacccctttccccaggcacagccccaggctggcaaagggagggccctgggctgggtgcaaggcgcgccaggagtcccagccagggtggccccggcgggggcgggtccagctttggaagccaggctcccctgtgagccgtggcttgtctggtcttcgcccacgggaggctggacagaggctgtagccaacacaatcacctttactttgtactctgtgtgtatgttttggttttctgtgttttaataaatcctttgggaaagg

SEQ ID NO: 5885 - DNA, 9531 bp, Homo sapiens
tcgcccgccgcgcgcgccggtccggcagcgcacgggttaaggctggcaccgcgcccggcgggagggggggcgcccacctcccctcctccccgcgccgggcatgcggggcccagtgggcaccgaggaggagctgccgcggctgttcgccgaggagatggagaatgaggacgagatgtcagaagaagaagatggtggtcttgaagccttcgatgactttttccctgtggagcccgtgagccttcctaagaagaagaaacccaagaagctcaaggaaaacaagtgtaaagggaagcggaagaagaaagaggggagcaatgatgagctatcagagaatgaagaggatctggaagagaagtcggagagtgaaggcagtgactactccccgaataaaaagaagaagaagaaactcaaggacaagaaggagaaaaaagccaagcgaaaaaagaaggatgaggatgaggatgataatgatgatggatgcttaaaggagcccaagtcctcggggcagctcatggccgagtggggcctggacgacgtggactacctgttctcggaggaggattaccacacgctgaccaactacaaggccttcagccagttcctcaggccactcattgccaagaagaacccgaagatccccatgtccaaaatgatgaccgtcctgggtgccaagtggcgggagttcagcgccaacaaccccttcaagggcagctccgcggcagcagcggcggcggcggtggctgcggctgtagagacggtcaccatctcccctccgctagccgtcagccccccgcaggtgccccagcctgtgcctatccgcaaggccaagaccaaggagggcaaagggcctggagtgaggaagaagatcaaaggctccaaagatgggaagaaaaagggcaaagggaaaaagacggccgggctcaagttccgcttcggggggatcagcaacaagaggaagaaaggctcctcgagtgaagaagatgagagggaggagtcggacttcgacagcgccagcatccacagtgcctccgtgcgctccgaatgctctgcagccctgggcaagaagagcaagaggaggcgcaagaagaagaggattgatgatggtgacggctatgagacagaccaccaggattactgtgaggtgtgccagcagggtggggagatcatcctgtgcgacacctgcccgagggcctaccatctcgtatgcctggacccagagctggagaaggctcccgagggcaagtggagctgcccccactgtgagaaggaggggatccagtgggagccgaaggacgacgacgatgaagaggaggagggcggctgcgaggaggaggaggacgaccacatggagttctgccgcgtgtgcaaggacgggggcgagctgctctgctgcgacgcctgcccctcctcctaccacctgcattgcctcaacccgccgctgcccgagatcccaaacggtgaatggctctgcccgcgctgtacttgccccccactgaagggcaaagtccagcggattctacactggaggtggacggagccccctgcccccttcatggtggggctgccggggcctgacgtggagcccagcctccctccacctaagcccctggagggcatccctgagagagagttctttgtcaagtgggcagggctgtcctactggcattgctcctgggtgaaggagctacagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccattgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagtcgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcgaacctgcagcactgatgtctctttaccgatgggttccagacccaaggtagtcctggcactgccctgtggactcagcccagctggggaggacatggcgcccggtgccctaggagccctcagtgtcccctacctgacctgtctgcacctgtgtgacagccccttctgatttggccccctgcccgcttggagcctcccagcaccagacagggcaggtttggggagccgctgtccagccctatggtgagaccctggctgacatttcccctccttcctgccaaggctggaggccgccaggtgtttgctctctccttgtggggaggtggatcctctgccagcaggtgtctgtccccggcccagcgcatcttgaaggccctggactctgttaccagtggggggcctgtggccccggctcttcacagcaggcagaagcgtatgatcccagggagggtgggctggggggggggcagcacttgcctcggagccactgctgcgttgggtttgccttctgccagaggtgtggttaagggcagtgatagctgcgccccagcaaggagggtcatgggccctgagctggcccaggagaccctggccctgccctgtgccctgggatgcctaccctgcccacctccggaggtggaaccgggctgcccctgggggcctggacttgtcccattcccctgtccctggaaaggccttcccgggggctttttgcctgaggctgcactcttggaaggcgtggggagagttctgcctggagggggactggacccagtgccctctgcagacccctcccagccgcagcaccaagggcttgctgccttgtttcctgccaggagcgccctgacatcccaaaaccatcttcccacatgtgggttgttggaatcccacccactcccccggaccctgcccctccaagttggggacggagatggggagcaggtcaggccctccctaggcctgtttgtgtgtgatccttctcctggccccaggtcgacctggaaggcgtttctgagtcttgtactgggaccttcccagggaaggtgccttggggtgcagaatcctgggaatgttaggaaagggctgcgtgaaaaacccagctgggcctggggtggaggtgcacacgggctggggctcagctccttggagagggcctgcctgggactgagggggccagggctgggtcaggattcaccagcttgtgttgcagacactggagcgattgcctggccctccctaagccctatatgcctcactcataatgaggctgtctctgaaccccggagggcgggacctacaagtccttcctcttggcgcattcccacactccagtctggatccaggtctgcaaggccagcccgaccctgacactgcacgtgggcgtagtggggagcaccctggagtggagatgattgtcagcgggctcacatgttatggttcatccacatgcgtgttgtgtgctctgcggtgcctcctggcaaagggtcctggctcgggtcagaagctcactcccgtgccctcgtccccaaacaagcagtggcaagcactggggttggccctcgttgggagcagtgcccaccttccttggcccacagcagataggtcccgagcagcaggactggaggcctgtggcggtcagggcaggggtctgtgtctccaccccaagggctgatggtccctcccctgtgcgccttcctctcaggcaggcttgctctgtcccttcctctctgcttccctcccaggcctcgccagggctcccttctcctctgcctggttagactcgggcacccaggaaagcctggccagggctcctttgggcctgggccccctgcactgcctggtccagaaggggtggtgctgtccgtggccagcaccccggggcccgggaggggtgggctactagagtcagagcgggtttggggctgaccagtttgggagaggagaaaagatctgagaatgtccttcttggtttgtcagtcatctctgccaaaagtggtgatggtggtgtccgtatgtttggcgtctttgggctgggtttggtttttgctgctggtagaatcagggtcctcgggcatgaacgcgagcccaaagtgccagtctgcgattggaaatttccagccactttaagccagtgctgagtagggcttctgcagagccatgtttgagccaaggtcttggaaggcattgccccatgggctcaggtgactcggggtggagtgagcacgtctgcagggccctctcatacacgcctgaggcagaagcagcgtcccccgtgaaagccaccttccgaagctcctgcgttttttgcaaacttggcttcccccaggggcaggctggactttccctgccccctatgattgaagtcctcctgcttttgggggctgccttcccagagtcccccgggtgctcccctgccgaggtcaggagctgaccaagccttggcccggtgacacctgcagccctcactcctgtcatcccaggacacttgaggcccaaggaggtggagtggagagtgggctcgggtacatgggagccagaagccagatggacttggtcaagtgtcggtcacttggagcctccagtgtgcgtcagggtctgtgggcaggggacagggcgtgggtgggggccgaggctggcacgcccctctgccctcaccgtcttggtgacctggcctcggcccctcccccaagtctcttctgtgcaaggcccgcctcggcctcggcagctggttcctgtcctgttttctgtgtctgaaagtttacaggttgtggtgcatcagcccaaactcactggcgttgtgttttttttttctttaattttcagattttttttttaaacaaagtatttttttaggtgcgataacccagaaagggcccgttgggtgtgtgtgtgtgtcctgaactcctcaagcagcgattggagcccaagcacccctggagaggaagggagggtccccactggcccgtggggtctgagttcaggggtgtggagggagcagactccaccggcccaggcccagctaagagggggccgacccctttccccaggcacagccccaggctggcaaagggagggccctgggctgggtgcaaggcgcgccaggagtcccagccagggtggccccggcgggggcgggtccagctttggaagccaggctcccctgtgagccgtggcttgtctggtcttcgcccacgggaggctggacagaggctgtagccaacacaatcacctttactttgtactctgtgtgtatgttttggttttctgtgttttaataaatcctttgggaaagg

SEQ ID NO: 5886 - DNA, 9750 bp, Homo sapiens
tcgcccgccgcgcgcgccggtccggcagcgcacgggttaaggctggcaccgcgcccggcgggagggggggcgcccacctcccctcctccccgcgccgggcatgcggggcccagtgggcaccgaggaggagctgccgcggctgttcgccgaggagatggagaatgaggacgagatgtcagaagaagaagatggtggtcttgaagccttcgatgactttttccctgtggagcccgtgagccttcctaagaagaagaaacccaagaagctcaaggaaaacaagtgtaaagggaagcggaagaagaaagaggggagcaatgatgagctatcagagaatgaagaggatctggaagagaagtcggagagtgaaggcagtgactactccccgaataaaaagaagaagaagaaactcaaggacaagaaggagaaaaaagccaagcgaaaaaagaaggatgaggatgaggatgataatgatgatggatgcttaaaggagcccaagtcctcggggcagctcatggccgagtggggcctggacgacgtggactacctgttctcggaggaggattaccacacgctgaccaactacaaggccttcagccagttcctcaggccactcattgccaagaagaacccgaagatccccatgtccaaaatgatgaccgtcctgggtgccaagtggcgggagttcagcgccaacaaccccttcaagggcagctccgcggcagcagcggcggcggcggtggctgcggctgtagagacggtcaccatctcccctccgctagccgtcagccccccgcaggtgccccagcctgtgcctatccgcaaggccaagaccaaggagggcaaagggcctggagtgaggaagaagatcaaaggctccaaagatgggaagaaaaagggcaaagggaaaaagacggccgggctcaagttccgcttcggggggatcagcaacaagaggaagaaaggctcctcgagtgaagaagatgagagggaggagtcggacttcgacagcgccagcatccacagtgcctccgtgcgctccgaatgctctgcagccctgggcaagaagagcaagaggaggcgcaagaagaagaggattgatgatggtgacggctatgagacagaccaccaggattactgtgaggtgtgccagcagggtggggagatcatcctgtgcgacacctgcccgagggcctaccatctcgtatgcctggacccagagctggagaaggctcccgagggcaagtggagctgcccccactgtgagaaggaggggatccagtgggagccgaaggacgacgacgatgaagaggaggagggcggctgcgaggaggaggaggacgaccacatggagttctgccgcgtgtgcaaggacgggggcgagctgctctgctgcgacgcctgcccctcctcctaccacctgcattgcctcaacccgccgctgcccgagatcccaaacggtgaatggctctgcccgcgctgtacttgccccccactgaagggcaaagtccagcggattctacactggaggtggacggagccccctgcccccttcatggtggggctgccggggcctgacgtggagcccagcctccctccacctaagcccctggagggcatccctgagagagagttctttgtcaagtgggcagggctgtcctactggcattgctcctgggtgaaggagctacagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccattgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagtcgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagcgtcttgctctgtcactcaggctggagtgcagtggcgccatcggctcatgggagcctttatctcctcggctcaagcgaccctcccacctcagcttcctgaacagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagggcgctttcggctcctcccagatgtacagcaacaactttgggcccaacttccggggccctggaccgggagggattgtcaactacaaccagatgcccctggggccctatgtgaccgatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcgaacctgcagcactgatgtctctttaccgatgggttccagacccaaggtagtcctggcactgccctgtggactcagcccagctggggaggacatggcgcccggtgccctaggagccctcagtgtcccctacctgacctgtctgcacctgtgtgacagccccttctgatttggccccctgcccgcttggagcctcccagcaccagacagggcaggtttggggagccgctgtccagccctatggtgagaccctggctgacatttcccctccttcctgccaaggctggaggccgccaggtgtttgctctctccttgtggggaggtggatcctctgccagcaggtgtctgtccccggcccagcgcatcttgaaggccctggactctgttaccagtggggggcctgtggccccggctcttcacagcaggcagaagcgtatgatcccagggagggtgggctggggggggggcagcacttgcctcggagccactgctgcgttgggtttgccttctgccagaggtgtggttaagggcagtgatagctgcgccccagcaaggagggtcatgggccctgagctggcccaggagaccctggccctgccctgtgccctgggatgcctaccctgcccacctccggaggtggaaccgggctgcccctgggggcctggacttgtcccattcccctgtccctggaaaggccttcccgggggctttttgcctgaggctgcactcttggaaggcgtggggagagttctgcctggagggggactggacccagtgccctctgcagacccctcccagccgcagcaccaagggcttgctgccttgtttcctgccaggagcgccctgacatcccaaaaccatcttcccacatgtgggttgttggaatcccacccactcccccggaccctgcccctccaagttggggacggagatggggagcaggtcaggccctccctaggcctgtttgtgtgtgatccttctcctggccccaggtcgacctggaaggcgtttctgagtcttgtactgggaccttcccagggaaggtgccttggggtgcagaatcctgggaatgttaggaaagggctgcgtgaaaaacccagctgggcctggggtggaggtgcacacgggctggggctcagctccttggagagggcctgcctgggactgagggggccagggctgggtcaggattcaccagcttgtgttgcagacactggagcgattgcctggccctccctaagccctatatgcctcactcataatgaggctgtctctgaaccccggagggcgggacctacaagtccttcctcttggcgcattcccacactccagtctggatccaggtctgcaaggccagcccgaccctgacactgcacgtgggcgtagtggggagcaccctggagtggagatgattgtcagcgggctcacatgttatggttcatccacatgcgtgttgtgtgctctgcggtgcctcctggcaaagggtcctggctcgggtcagaagctcactcccgtgccctcgtccccaaacaagcagtggcaagcactggggttggccctcgttgggagcagtgcccaccttccttggcccacagcagataggtcccgagcagcaggactggaggcctgtggcggtcagggcaggggtctgtgtctccaccccaagggctgatggtccctcccctgtgcgccttcctctcaggcaggcttgctctgtcccttcctctctgcttccctcccaggcctcgccagggctcccttctcctctgcctggttagactcgggcacccaggaaagcctggccagggctcctttgggcctgggccccctgcactgcctggtccagaaggggtggtgctgtccgtggccagcaccccggggcccgggaggggtgggctactagagtcagagcgggtttggggctgaccagtttgggagaggagaaaagatctgagaatgtccttcttggtttgtcagtcatctctgccaaaagtggtgatggtggtgtccgtatgtttggcgtctttgggctgggtttggtttttgctgctggtagaatcagggtcctcgggcatgaacgcgagcccaaagtgccagtctgcgattggaaatttccagccactttaagccagtgctgagtagggcttctgcagagccatgtttgagccaaggtcttggaaggcattgccccatgggctcaggtgactcggggtggagtgagcacgtctgcagggccctctcatacacgcctgaggcagaagcagcgtcccccgtgaaagccaccttccgaagctcctgcgttttttgcaaacttggcttcccccaggggcaggctggactttccctgccccctatgattgaagtcctcctgcttttgggggctgccttcccagagtcccccgggtgctcccctgccgaggtcaggagctgaccaagccttggcccggtgacacctgcagccctcactcctgtcatcccaggacacttgaggcccaaggaggtggagtggagagtgggctcgggtacatgggagccagaagccagatggacttggtcaagtgtcggtcacttggagcctccagtgtgcgtcagggtctgtgggcaggggacagggcgtgggtgggggccgaggctggcacgcccctctgccctcaccgtcttggtgacctggcctcggcccctcccccaagtctcttctgtgcaaggcccgcctcggcctcggcagctggttcctgtcctgttttctgtgtctgaaagtttacaggttgtggtgcatcagcccaaactcactggcgttgtgttttttttttctttaattttcagattttttttttaaacaaagtatttttttaggtgcgataacccagaaagggcccgttgggtgtgtgtgtgtgtcctgaactcctcaagcagcgattggagcccaagcacccctggagaggaagggagggtccccactggcccgtggggtctgagttcaggggtgtggagggagcagactccaccggcccaggcccagctaagagggggccgacccctttccccaggcacagccccaggctggcaaagggagggccctgggctgggtgcaaggcgcgccaggagtcccagccagggtggccccggcgggggcgggtccagctttggaagccaggctcccctgtgagccgtggcttgtctggtcttcgcccacgggaggctggacagaggctgtagccaacacaatcacctttactttgtactctgtgtgtatgttttggttttctgtgttttaataaatcctttgggaaagg

SEQ ID NO: 5887 - DNA, 9752 bp, Homo sapiens
tcgcccgccgcgcgcgccggtccggcagcgcacgggttaaggctggcaccgcgcccggcgggagggggggcgcccacctcccctcctccccgcgccgggcatgcggggcccagtgggcaccgaggaggagctgccgcggctgttcgccgaggagatggagaatgaggacgagatgtcagaagaagaagatggtggtcttgaagccttcgatgactttttccctgtggagcccgtgagccttcctaagaagaagaaacccaagaagctcaaggaaaacaagtgtaaagggaagcggaagaagaaagaggggagcaatgatgagctatcagagaatgaagaggatctggaagagaagtcggagagtgaaggcagtgactactccccgaataaaaagaagaagaagaaactcaaggacaagaaggagaaaaaagccaagcgaaaaaagaaggatgaggatgaggatgataatgatgatggatgcttaaaggagcccaagtcctcggggcagctcatggccgagtggggcctggacgacgtggactacctgttctcggaggaggattaccacacgctgaccaactacaaggccttcagccagttcctcaggccactcattgccaagaagaacccgaagatccccatgtccaaaatgatgaccgtcctgggtgccaagtggcgggagttcagcgccaacaaccccttcaagggcagctccgcggcagcagcggcggcggcggtggctgcggctgtagagacggtcaccatctcccctccgctagccgtcagccccccgcaggtgccccagcctgtgcctatccgcaaggccaagaccaaggagggcaaagggcctggagtgaggaagaagatcaaaggctccaaagatgggaagaaaaagggcaaagggaaaaagacggccgggctcaagttccgcttcggggggatcagcaacaagaggaagaaaggctcctcgagtgaagaagatgagagggaggagtcggacttcgacagcgccagcatccacagtgcctccgtgcgctccgaatgctctgcagccctgggcaagaagagcaagaggaggcgcaagaagaagaggattgatgatggtgacggctatgagacagaccaccaggattactgtgaggtgtgccagcagggtggggagatcatcctgtgcgacacctgcccgagggcctaccatctcgtatgcctggacccagagctggagaaggctcccgagggcaagtggagctgcccccactgtgagaaggaggggatccagtgggagccgaaggacgacgacgatgaagaggaggagggcggctgcgaggaggaggaggacgaccacatggagttctgccgcgtgtgcaaggacgggggcgagctgctctgctgcgacgcctgcccctcctcctaccacctgcattgcctcaacccgccgctgcccgagatcccaaacggtgaatggctctgcccgcgctgtacttgccccccactgaagggcaaagtccagcggattctacactggaggtggacggagccccctgcccccttcatggtggggctgccggggcctgacgtggagcccagcctccctccacctaagcccctggagggcatccctgagagagagttctttgtcaagtgggcagggctgtcctactggcattgctcctgggtgaaggagctacagctggagctgtaccacacggtgatgtatcgcaactaccaaagaaagaacgacatggatgagccgcccccctttgactacggctctggggatgaagacggcaagagcgagaagaggaagaacaaggaccccctctatgccaagatggaggagcgcttctaccgctatggcatcaagccagagtggatgatgattcaccgaatcctgaaccatagctttgacaagaagggggatgtgcactacctgatcaagtggaaagacctgccctacgaccagtgcacctgggagatcgatgacatcgacatcccctactacgacaacctcaagcaggcctactggggccacagggagctgatgctgggagaagacaccaggctgcccaagaggctgctcaagaagggcaagaagctgagggacgacaagcaggagaagccgccggacacgcccattgtggaccccacggtcaagttcgacaagcagccatggtacatcgactccacaggcggcacactgcacccgtaccagctggagggcctcaactggctgcgcttctcttgggcccagggcactgacaccatcctggccgatgagatgggtctgggcaagacggtgcagaccatcgtgttcctttactccctctacaaggagggccactccaaagggccctacctggttagcgcgcccctctccaccatcatcaactgggaacgcgagtttgagatgtgggcgcccgacttctacgtggtcacctacacgggggacaaggagagccgctcggtgattcgggagaacgagttttcctttgaggacaacgccattcggagtgggaagaaggtattccgtatgaagaaagaagtgcagatcaaattccacgtgctgctcacctcctatgagctcatcaccattgaccaggccatcctgggctccatcgagtgggcctgcctggtggtagatgaggcccaccgcctcaagaacaaccagtccaagttttttagggtcttaaacagctacaagattgattacaagctgctgctgacagggaccccccttcagaacaacctggaggagctgttccatctcctcaacttcctgactccagagaggttcaacaacctggagggcttcctggaggagtttgctgacatctccaaggaagaccagatcaagaagctgcatgacctgctggggccgcacatgctcaggcggctcaaggctgacgtgttcaagaacatgccggccaagaccgagctcattgtccgggtggagctgagccagatgcagaagaagtactacaagttcatcctcacacggaactttgaggcactgaactccaaggggggcgggaaccaagtatcgctgctcaacatcatgatggacctgaaaaagtgctgcaaccacccctacctcttccctgtggctgccgtggaggcccctgtcttgcccaatggctcctacgatggaagctccctggtcaagtcttcagggaagctcatgctgctacagaagatgctgaagaaactgcgggatgaggggcaccgtgtgctcatcttctcccagatgaccaagatgctggacctcctggaggacttcctggagtacgaaggctacaagtatgagcggattgatggtggcatcaccgggggcctccggcaggaggcaatcgacagattcaatgcccccggggcccagcagttctgcttcctcctctcaacccgggcaggtggtctgggcatcaacctggccacggcggacactgtcatcatctacgactcggactggaacccgcacaatgacatccaggccttcagccgcgcccaccgcatcggccagaacaagaaggtgatgatctaccgcttcgtgactcgggcctcggtggaggagcgcatcacgcaggtggccaagcgcaagatgatgctcacccacctggtggtgcggcccggcctcggctccaagtcggggtccatgaccaagcaggagctggacgacatcctcaagttcggcacggaggaactcttcaaggacgacgtggagggcatgatgtctcagggccagaggccggtcacacccatccctgatgtccagtcctccaaaggggggaacttggccgccagtgcaaagaagaagcacggtagcaccccgccaggtgacaacaaggacgtggaggacagcagtgtgatccactatgacgatgcggccatctccaagctgctggaccggaaccaggacgctacagatgacacggagctacagaacatgaacgagtacctgagctccttcaaggtggcgcagtacgtggtgcgcgaggaggacggcgtggaggaggtggagcgggaaatcatcaagcaggaggagaacgtggaccccgactactgggagaagctgctgcggcaccactatgagcagcagcaggaggacctggcccgcaacctgggcaagggcaagcgcatccgcaagcaggtcaactacaacgatgcctcccaggaggaccaggagtggcaggatgagctctctgataaccagtcagaatattccattggctctgaggatgaggatgaggactttgaagagaggccggaagggcagagtggacgacgacaatcccggaggcagctgaagagtgacagggacaagcccctgcccccgcttctcgcccgagttggtggcaacatcgaggtgctgggcttcaatgcccgacagcggaaggcctttctgaacgccatcatgcgctggggcatgcccccgcaggacgccttcaactcccactggctggtgcgggaccttcgagggaagagcgagaaggagtttagagcctatgtgtccctcttcatgcggcacctgtgtgagccgggggcggatggtgcagagaccttcgcagacggcgtgccccgggagggcctctccaggcagcacgtgctgacccgcatcggggtcatgtcactagttaggaagaaggttcaggagtttgagcatgtcaacgggaagtacagcaccccagacttgatccctgaggggcccgaggggaagaagtcgggcgaggtgatctcctcggaccccaacacaccagtgcccgccagccctgcccacctcctgccagccccgctgggcctgccagacaaaatggaagcccagctgggctacatggatgagaaagaccccggggcacagaagccaaggcagcccctggaagtccaggcccttccagccgccttggatagagtggagagtgaggacaagcacgagagcccagccagcaaggagagagcccgagaggagcggccagaggagacggagaaggccccgccctccccggagcagctgccgagagcgtcttgctctgtcactcaggctggagtgcagtggcgccatctcggctcatgggagcctttatctcctcggctcaagcgaccctcccacctcagcttcctgaacagaggaggtgcttcctgagaaggagaagatcctggacaagctggagctgagcttgatccacagcagaggggacagttccgaactcaggccagatgacaccaaggctgaggagaaggagcccattgaaacacagcaaaatggtgacaaagaggaagatgacgaggggaagaaggaggacaagaaggggaaattcaagttcatgttcaacatcgcggacgggggcttcacggagttgcacacgctgtggcagaacgaggagcgggctgctgtatcctctgggaaaatctacgacatctggcaccggcgccatgactactggctgctggcgggcatcgtgacgcacggctacgcccgctggcaggacatccagaatgacccacggtacatgatcctcaacgagcccttcaagtctgaggtccacaagggcaactacctggagatgaagaacaagttcctggcccgcaggtttaagctgctggagcaggcgttggtcattgaggagcagctccggagggccgcgtacctgaacatgacgcaggaccccaaccaccccgccatggccctcaacgcccgcctggctgaagtggagtgcctcgccgagagccaccagcacctgtccaaggagtcccttgctgggaacaagcctgccaatgccgtcctgcacaaggtcctgaaccagctggaggagctgctgagcgacatgaaggccgacgtgacccggctgccatccatgctgtcccgcatccccccggtggccgcccggctgcagatgtcggagcgcagcatcctgagccgcctgaccaaccgcgccggggaccccaccatccagcagggcgctttcggctcctcccagatgtacagcaacaactttgggcccaacttccggggccctggaccgggagggattgtcaactacaaccagatgcccctggggccctatgtgaccgatatctagccgtcctcgagacttccctgtgttgcagcgctcatttccagctgagccacgcctgccgggccacctgcccgacccacatgggagagaaaagctgccacctttttaggagccagcgccaccttgggacaaaaagggaaacctagtaatgccatcacatggaggacgaggcccagctcagctgggccagagcccagaagtgccacctcatcataattcaagtgttcttccacacagcgttgcccccacaaccacgccggacgtgccccctcgccaccttttccagacgacttcttagaagagatttcatttatttgtacatcttttgcactttcctattgaagacttgaacacgtttgtcttgataaaagttggatgacgtatggaagattcgaacctgcagcactgatgtctctttaccgatgggttccagacccaaggtagtcctggcactgccctgtggactcagcccagctggggaggacatggcgcccggtgccctaggagccctcagtgtcccctacctgacctgtctgcacctgtgtgacagccccttctgatttggccccctgcccgcttggagcctcccagcaccagacagggcaggtttggggagccgctgtccagccctatggtgagaccctggctgacatttcccctccttcctgccaaggctggaggccgccaggtgtttgctctctccttgtggggaggtggatcctctgccagcaggtgtctgtccccggcccagcgcatcttgaaggccctggactctgttaccagtggggggcctgtggccccggctcttcacagcaggcagaagcgtatgatcccagggagggtgggctggggggggggcagcacttgcctcggagccactgctgcgttgggtttgccttctgccagaggtgtggttaagggcagtgatagctgcgccccagcaaggagggtcatgggccctgagctggcccaggagaccctggccctgccctgtgccctgggatgcctaccctgcccacctccggaggtggaaccgggctgcccctgggggcctggacttgtcccattcccctgtccctggaaaggccttcccgggggctttttgcctgaggctgcactcttggaaggcgtggggagagttctgcctggagggggactggacccagtgccctctgcagacccctcccagccgcagcaccaagggcttgctgccttgtttcctgccaggagcgccctgacatcccaaaaccatcttcccacatgtgggttgttggaatcccacccactcccccggaccctgcccctccaagttggggacggagatggggagcaggtcaggccctccctaggcctgtttgtgtgtgatccttctcctggccccaggtcgacctggaaggcgtttctgagtcttgtactgggaccttcccagggaaggtgccttggggtgcagaatcctgggaatgttaggaaagggctgcgtgaaaaacccagctgggcctggggtggaggtgcacacgggctggggctcagctccttggagagggcctgcctgggactgagggggccagggctgggtcaggattcaccagcttgtgttgcagacactggagcgattgcctggccctccctaagccctatatgcctcactcataatgaggctgtctctgaaccccggagggcgggacctacaagtccttcctcttggcgcattcccacactccagtctggatccaggtctgcaaggccagcccgaccctgacactgcacgtgggcgtagtggggagcaccctggagtggagatgattgtcagcgggctcacatgttatggttcatccacatgcgtgttgtgtgctctgcggtgcctcctggcaaagggtcctggctcgggtcagaagctcactcccgtgccctcgtccccaaacaagcagtggcaagcactggggttggccctcgttgggagcagtgcccaccttccttggcccacagcagataggtcccgagcagcaggactggaggcctgtggcggtcagggcaggggtctgtgtctccaccccaagggctgatggtccctcccctgtgcgccttcctctcaggcaggcttgctctgtcccttcctctctgcttccctcccaggcctcgccagggctcccttctcctctgcctggttagactcgggcacccaggaaagcctggccagggctcctttgggcctgggccccctgcactgcctggtccagaaggggtggtgctgtccgtggccagcaccccggggcccgggaggggtgggctactagagtcagagcgggtttggggctgaccagtttgggagaggagaaaagatctgagaatgtccttcttggtttgtcagtcatctctgccaaaagtggtgatggtggtgtccgtatgtttggcgtctttgggctgggtttggtttttgctgctggtagaatcagggtcctcgggcatgaacgcgagcccaaagtgccagtctgcgattggaaatttccagccactttaagccagtgctgagtagggcttctgcagagccatgtttgagccaaggtcttggaaggcattgccccatgggctcaggtgactcggggtggagtgagcacgtctgcagggccctctcatacacgcctgaggcagaagcagcgtcccccgtgaaagccaccttccgaagctcctgcgttttttgcaaacttggcttcccccaggggcaggctggactttccctgccccctatgattgaagtcctcctgcttttgggggctgccttcccagagtcccccgggtgctcccctgccgaggtcaggagctgaccaagccttggcccggtgacacctgcagccctcactcctgtcatcccaggacacttgaggcccaaggaggtggagtggagagtgggctcgggtacatgggagccagaagccagatggacttggtcaagtgtcggtcacttggagcctccagtgtgcgtcagggtctgtgggcaggggacagggcgtgggtgggggccgaggctggcacgcccctctgccctcaccgtcttggtgacctggcctcggcccctcccccaagtctcttctgtgcaaggcccgcctcggcctcggcagctggttcctgtcctgttttctgtgtctgaaagtttacaggttgtggtgcatcagcccaaactcactggcgttgtgttttttttttctttaattttcagattttttttttaaacaaagtatttttttaggtgcgataacccagaaagggcccgttgggtgtgtgtgtgtgtcctgaactcctcaagcagcgattggagcccaagcacccctggagaggaagggagggtccccactggcccgtggggtctgagttcaggggtgtggagggagcagactccaccggcccaggcccagctaagagggggccgacccctttccccaggcacagccccaggctggcaaagggagggccctgggctgggtgcaaggcgcgccaggagtcccagccagggtggccccggcgggggcgggtccagctttggaagccaggctcccctgtgagccgtggcttgtctggtcttcgcccacgggaggctggacagaggctgtagccaacacaatcacctttactttgtactctgtgtgtatgttttggttttctgtgttttaataaatcctttgggaaagg

SEQ ID NO: 5888 - DNA, 10446 bp, Homo sapiens
cggcggcggcggcagcggcggcggcggcggcggcgcgggggttgagtcgtggtggtgcggacgcgctcgtgctcgggaactatcggattaaacttgaatcgagtgaaattacacaaaggagcgccgcggaggaggcggcccggggacccggacaccctgaaactcaccagagacccgttcgcccccggccaactccgtgcccgtggattcagccccctggccgcagctgccgagccaactccggagcccgctctgcgttttgttttcccctcggcactaggcagcggaggagcccgaccgacccggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaaaaaagaaaaagaaaaggtcaaaggcaaaaaaagacccgaaggaaccgaaagaacccaaggagaaaaaagagcccaaggaacccaagaccccgaaagcccctaagattcccaaagagccaaaggaaaagaaagcaaaaactgccacgccaaaacccaaatccagcaaaaagtcaagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcagaagagacggtccagcagacaggtgaagagaaagcgctacactgaagacctggagttcaagatttctgatgaggaggcagatgatgcagatgctgctgggagggattccccctccaacacctcccagtcagaacagcaggaatctgttgatgcagaaggcccagtggtagaaaaaattatgagcagtcgttcagtaaaaaagcagaaggaatctggagaggaggtagaaattgaggaattctatgtgaaatacaaaaacttctcttatcttcattgtcagtgggcatctatagaagatctggaaaaagataagagaattcagcaaaaaattaaacgatttaaggcaaagcagggccagaacaagttcctttcagagattgaggatgagctttttaatccagattatgtggaggttgaccggataatggactttgcacgtagcacagatgaccggggagagcctgtgactcactatctggtgaagtggtgttcacttccttatgaagacagcacgtgggagcggaggcaggacatagatcaagcaaagatcgaggagtttgagaaactaatgtccagggagccggaaacagagcgtgtggagcgacctcctgctgatgattggaagaaatcggagagttccagggagtataaaaacaataacaaactcagggaataccagttggagggagtaaactggctacttttcaattggtacaacatgcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggaacacaaagtgctgctgacgggaaccccactccagaacactgtggaagaactcttcagcttgcttcatttcttggaaccaagtcgcttcccttcagaaaccacatttatgcaagaatttggtgatctaaaaacagaagagcaggtgcaaaaacttcaagctattctaaagccaatgatgttgagacgtctcaaagaggatgtagaaaagaacttggcccccaaagaagaaactattattgaagttgagctaacaaacattcagaagaaatattaccgagccatccttgagaagaatttcacatttctttccaaaggcggtggtcaagctaacgtacctaacctattaaacactatgatggaattgcggaagtgctgcaatcatccgtaccttatcaatggtgctgaagagaaaattttggaagagtttaaagaaacacacaatgcagagtctccagattttcagctccaggcaatgatccaggctgctggcaagctagtgctgattgacaagctgctgccaaaactgaaggctggtggccacagggtgcttatcttttcccagatggtgcgctgcttggacatactggaagactacctcattcaaagacggtacccatatgaaaggatcgacggccgagtaagaggcaacctccgccaggcagctatcgacagattctccaaacctgattctgataggtttgttttcctcctgtgtacaagggcaggaggtttaggcattaacctcactgctgctgatacctgcatcatctttgattcagactggaatccccaaaatgacctccaggctcaggctagatgtcatagaataggacagagcaaatctgtgaaaatctacaggctgattacaagaaattcctatgaaagggaaatgttcgacaaggctagtttgaaactgggcctggataaagctgtgctacagtctatgagtggaagagaaaatgctaccaatggggtacaacagctttccaagaaagaaatagaggatcttctacgaaaaggggcctatggtgcactcatggatgaggaggatgaagggtctaaattctgtgaagaagatattgatcagatcctcctacgtcgaacccacaccattaccattgagtcagaagggaaaggttccacatttgctaaggccagttttgttgcatctggaaataggacagatatttccttggatgatccaaatttctggcaaaagtgggctaagaaggctgaattggatattgatgccttaaatgggaggaacaacctggttattgatactccaagagtgagaaagcagaccaggctctacagtgcagtgaaggaagatgagctgatggagttctcagacttggaaagtgattctgaagaaaagccctgtgcaaagccacggcgtccccaggataagtcacagggctatgcaaggagtgaatgtttcagggtggagaagaatctgcttgtctatggttggggacggtggacagacattctttcccacggacgctataaacgccaactcactgagcaagatgtagaaaccatctgcagaaccatcctggtgtactgtcttaatcattacaaaggggatgagaatatcaaaagcttcatctgggatctgatcacacccacagcggatggccagactcgagccttggtcaaccattccggtttgtcagctcctgtgccaaggggaaggaagggaaagaaggtgaaagcccagagcacacagccggtggtgcaggatgccgactggctggccagctgcaacccagatgccctgttccaggaggacagctacaagaaacacctgaagcatcactgtaacaaggtcctgctgcgtgtccgcatgctgtactacctaagacaagaagtgataggagaccaggcggataagatcttagagggtgctgactcaagtgaagccgatgtgtggatccctgaacctttccatgctgaagttcctgcagattggtgggataaggaagcagacaaatccctcttaattggagtgttcaaacatggctatgagaagtacaactccatgcgagctgaccccgcgctgtgctttctggaacgagtcggtatgcctgatgccaaggccatagctgccgagcaaagaggaacagacatgctagcagatggtggtgacgggggagaatttgatagagaagatgaagacccagaatataaaccaaccagaacaccgttcaaagatgaaatagatgaatttgcaaattctccttcagaggataaggaagaatccatggaaatacatgccacaggtaagcacagtgagagtaatgctgagttaggccaactttactggcctaacacttcaaccctgactacacgtctgcgccggctcattactgcctatcagcgcagctataaaaggcaacagatgaggcaagaggccctaatgaagactgaccggcgcagacggcggcctcgagaggaagtgagagctctggaagcggaaagggaagctattatatctgagaagcggcaaaagtggacaagaagagaagaggctgatttttaccgtgtggtatccacctttggggttatttttgaccctgtgaaacagcaatttgactggaaccaatttagagcctttgccaggcttgacaaaaaatctgatgagagtttggagaaatacttcagttgttttgtggccatgtgtaggcgagtatgtcgaatgcccgtcaagccagatgatgaaccgcccgacctctcctccataattgagccgatcacagaggagcgagcctctcgaactctgtaccgcattgagctgctacggaagatccgcgagcaggttctccatcacccccagctgggagagaggcttaagctctgccagccaagcttggatctgccagagtggtgggagtgtggacggcatgaccgagacttgctggttggtgctgctaaacacggggtcagtcggacggattatcacatcctcaatgaccctgagttatccttcttggatgcacataaaaactttgctcaaaacagaggggcaggtaatacatcttccttgaacccactggcagttggatttgtccagactcctccagtcatctcatctgctcatattcaagatgagagggtactggaacaagccgaaggcaaagtggaggagcctgaaaacccagctgccaaggagaaatgtgagggcaaagaagaggaagaagaaaccgatggcagcgggaaggagagcaagcaggaatgtgaggcagaggccagctctgtgaaaaatgaactgaaaggtgttgaggtcggcgcagacactgggtccaaatctatttcagagaaaggttccgaagaggatgaagaggaaaagctggaggatgacgataagtcggaagagtcttcccagcccgaagcaggagctgtctctagagggaagaattttgatgaagaaagcaatgcttccatgagcactgctagagatgaaacccgagatggattctacatggaggacggagatccttcagtagctcagctccttcatgaaagaacatttgccttctcgttttggcctaaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatcactacgtctcctcagttgtcaaaggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtctcaacaccagtgtctgatgcctttaagactcaaatggaactgctccaagcaggcctttcgcgcacacccacaaggcatctccttaatggctccctagtggatggagagcctcccatgaagaggaggcggggaaggaggaaaaatgtggagggacttgatctgcttttcatgagccacaaacggacgtcattgagtgcagaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccaaagaatgcagatgtgctgttttcctcatttcagaaaccgaaacagaaacgacatagatgtcgaaaccctaataaattggatataaacactttgacaggagaagaaagggtgcctgttgtcaataaacgaaatgggaagaagatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgcagagatgtaa

SEQ ID NO: 5889 - DNA, 10442 bp, Homo sapiens
gcggcggcggcagcggcggcggcggcggcggcgcgggggttgagtcgtggtggtgcggacgcgctcgtgctcgggaactatcggattaaacttgaatcgagtgaaattacacaaaggagcgccgcggaggaggcggcccggggacccggacaccctgaaactcaccagagacccgttcgcccccggccaactccgtgcccgtggattcagccccctggccgcagctgccgagccaactccggagcccgctctgcgttttgttttcccctcggcactaggcagcggaggagcccgaccgacccggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaaaaaagaaaaagaaaaggtcaaaggcaaaaaaagacccgaaggaaccgaaagaacccaaggagaaaaaagagcccaaggaacccaagaccccgaaagcccctaagattcccaaagagccaaaggaaaagaaagcaaaaactgccacgccaaaacccaaatccagcaaaaagtcaagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcagaagagacggtccagcagacaggtgaagagaaagcgctacactgaagacctggagttcaagatttctgatgaggaggcagatgatgcagatgctgctgggagggattccccctccaacacctcccagtcagaacagcaggaatctgttgatgcagaaggcccagtggtagaaaaaattatgagcagtcgttcagtaaaaaagcagaaggaatctggagaggaggtagaaattgaggaattctatgtgaaatacaaaaacttctcttatcttcattgtcagtgggcatctatagaagatctggaaaaagataagagaattcagcaaaaaattaaacgatttaaggcaaagcagggccagaacaagttcctttcagagattgaggatgagctttttaatccagattatgtggaggttgaccggataatggactttgcacgtagcacagatgaccggggagagcctgtgactcactatctggtgaagtggtgttcacttccttatgaagacagcacgtgggagcggaggcaggacatagatcaagcaaagatcgaggagtttgagaaactaatgtccagggagccggaaacagagcgtgtggagcgacctcctgctgatgattggaagaaatcggagagttccagggagtataaaaacaataacaaactcagggaataccagttggagggagtaaactggctacttttcaattggtacaacatgcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggaacacaaagtgctgctgacgggaaccccactccagaacactgtggaagaactcttcagcttgcttcatttcttggaaccaagtcgcttcccttcagaaaccacatttatgcaagaatttggtgatctaaaaacagaagagcaggtgcaaaaacttcaagctattctaaagccaatgatgttgagacgtctcaaagaggatgtagaaaagaacttggcccccaaagaagaaactattattgaagttgagctaacaaacattcagaagaaatattaccgagccatccttgagaagaatttcacatttctttccaaaggcggtggtcaagctaacgtacctaacctattaaacactatgatggaattgcggaagtgctgcaatcatccgtaccttatcaatggtgctgaagagaaaattttggaagagtttaaagaaacacacaatgcagagtctccagattttcagctccaggcaatgatccaggctgctggcaagctagtgctgattgacaagctgctgccaaaactgaaggctggtggccacagggtgcttatcttttcccagatggtgcgctgcttggacatactggaagactacctcattcaaagacggtacccatatgaaaggatcgacggccgagtaagaggcaacctccgccaggcagctatcgacagattctccaaacctgattctgataggtttgttttcctcctgtgtacaagggcaggaggtttaggcattaacctcactgctgctgatacctgcatcatctttgattcagactggaatccccaaaatgacctccaggctcaggctagatgtcatagaataggacagagcaaatctgtgaaaatctacaggctgattacaagaaattcctatgaaagggaaatgttcgacaaggctagtttgaaactgggcctggataaagctgtgctacagtctatgagtggaagagaaaatgctaccaatggggtacaacagctttccaagaaagaaatagaggatcttctacgaaaaggggcctatggtgcactcatggatgaggaggatgaagggtctaaattctgtgaagaagatattgatcagatcctcctacgtcgaacccacaccattaccattgagtcagaagggaaaggttccacatttgctaaggccagttttgttgcatctggaaataggacagatatttccttggatgatccaaatttctggcaaaagtgggctaagaaggctgaattggatattgatgccttaaatgggaggaacaacctggttattgatactccaagagtgagaaagcagaccaggctctacagtgcagtgaaggaagatgagctgatggagttctcagacttggaaagtgattctgaagaaaagccctgtgcaaagccacggcgtccccaggataagtcacagggctatgcaaggagtgaatgtttcagggtggagaagaatctgcttgtctatggttggggacggtggacagacattctttcccacggacgctataaacgccaactcactgagcaagatgtagaaaccatctgcagaaccatcctggtgtactgtcttaatcattacaaaggggatgagaatatcaaaagcttcatctgggatctgatcacacccacagcggatggccagactcgagccttggtcaaccattccggtttgtcagctcctgtgccaaggggaaggaagggaaagaaggtgaaagcccagagcacacagccggtggtgcaggatgccgactggctggccagctgcaacccagatgccctgttccaggaggacagctacaagaaacacctgaagcatcactgtaacaaggtcctgctgcgtgtccgcatgctgtactacctaagacaagaagtgataggagaccaggcggataagatcttagagggtgctgactcaagtgaagccgatgtgtggatccctgaacctttccatgctgaagttcctgcagattggtgggataaggaagcagacaaatccctcttaattggagtgttcaaacatggctatgagaagtacaactccatgcgagctgaccccgcgctgtgctttctggaacgagtcggtatgcctgatgccaaggccatagctgccgagcaaagaggaacagacatgctagcagatggtggtgacgggggagaatttgatagagaagatgaagacccagaatataaaccaaccagaacaccgttcaaagatgaaatagatgaatttgcaaattctccttcagaggataaggaagaatccatggaaatacatgccacaggcaagcacagtgagagtaatgctgagttaggccaactttactggcctaacacttcaaccctgactacacgtctgcgccggctcattactgcctatcagcgcagctataaaaggcaacagatgaggcaagaggccctaatgaagactgaccggcgcagacggcggcctcgagaggaagtgagagctctggaagcggaaagggaagctattatatctgagaagcggcaaaagtggacaagaagagaagaggctgatttttaccgtgtggtatccacctttggggttatttttgaccctgtgaaacagcaatttgactggaaccaatttagagcctttgccaggcttgacaaaaaatctgatgagagtttggagaaatacttcagttgttttgtggccatgtgtaggcgagtatgtcgaatgcccgtcaagccagatgatgaaccgcccgacctctcctccataattgagccgatcacagaggagcgagcctctcgaactctgtaccgcattgagctgctacggaagatccgcgagcaggttctccatcacccccagctgggagagaggcttaagctctgccagccaagcttggatctgccagagtggtgggagtgtggacggcatgaccgagacttgctggttggtgctgctaaacacggggtcagtcggacggattatcacatcctcaatgaccctgagttatccttcttggatgcacataaaaactttgctcaaaacagaggggcaggtaatacatcttccttgaacccactggcagttggatttgtccagactcctccagtcatctcatctgctcatattcaagatgagagggtactggaacaagccgaaggcaaagtggaggagcctgaaaacccagctgccaaggagaaatgtgagggcaaagaagaggaagaagaaaccgatggcagcgggaaggagagcaagcaggaatgtgaggcagaggccagctctgtgaaaaatgaactgaaaggtgttgaggtcggcgcagacactgggtccaaatctatttcagagaaaggttccgaagaggatgaagaggaaaagctggaggatgacgataagtcggaagagtcttcccagcccgaagcaggagctgtctctagagggaagaattttgatgaagaaagcaatgcttccatgagcactgctagagatgaaacccgagatggattctacatggaggacggagatccttcagtagctcagctccttcatgaaagaacatttgccttctcgttttggcctaaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatcactacgtctcctcagttgtcaaaggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtctcaacaccagtgtctgatgcctttaagactcaaatggaactgctccaagcaggcctttcgcgcacacccacaaggcatctccttaatggctccctagtggatggagagcctcccatgaagaggaggcggggaaggaggaaaaatgtggagggacttgatctgcttttcatgagccacaaacggacgtcattgagtgcagaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccaaagaatgcagatgtgctgttttcctcatttcagaaaccgaaacagaaacgacatagatgtcgaaaccctaataaattggatataaacactttgacaggagaagaaagggtgcctgttgtcaataaacgaaatgggaagaagatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgcagagatgt

SEQ ID NO: 5890 - DNA, 500 bp, Homo sapiens
ttgggctccaactcaagtgcgagcgggcgatgggcgcgcgggcgcggggcggctgagcagcggcggcggcggctcggggacggcggcgacccccgcctcccgcccccgccccccgctccggaccgaccacgccgcgctcgccgggagctgcggccgcaccggcgcgaacaaagtgcgttcctcccggcgcggcggcgccagcccgcgcggggaccgccaccgagcgaggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatcc

SEQ ID NO: 5891 - DNA, 7324 bp, Homo sapiens
aaaggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggaccaggacaaagcccaggacaaagactttcagtaccagtcaaggtggtactgcagccacaggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaacaccatcactcctgtagtgggtaagaagagaaaacgtaatacctcatctgataattcagatgtggaagtcatgcctgcacagtcacctcgagaagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatccttttcc

SEQ ID NO: 5892 - DNA, 8229 bp, Homo sapiens
gccagtaccccccctccccttccctccctagaccttggagaagtaccctccattactttcccaagatggcagaccccatcatggatctgttcgatgacccaaatttatttggcctggactctctgactgatgacagctttaaccaggtcacacaagaccccattgaggaagcccttggactgccaagctctctggactccttggatcagatgaaccaggatggtggaggtggtgatgtggggaattcatcagcaagtgaactggtccctccaccagaggaaacagctcccacagaactttccaaagaatccacagctccagctccagaatccataaccttgcatgattataccactcagcctgccagccaggagcagccagcccaacctgtcttacagacatcgacgccaacatcaggacttttgcaagtctccaagagccaggagatcctgagccaagggaatcctttcatgggtgtctctgccacagctgtctcctccagtagtgctggagggcagccacctcagtcagcccctaagattgttatccttaaggccccaccaagctcctcagtcactggtgcccatgtggcacaaattcaggcccaaggtatcaccagcacagctcagcccctggtggcaggcacagccaatggtggaaaagtcacttttaccaaagtgctaaccggcacaccccttcgaccaggtgtttccattgtctctggtaatacagtgttggccgccaaggtccctgggaaccaggctgctgttcagcgcattgtccagcccagccgaccagtaaagcagctggtcctccagccagttaagggttcagctcctgctggaaaccctggggccacagggcccccactgaagcctgcagttacactgacctctacacctacccagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggaccaggacaaagcccaggacaaagactttcagtaccagtcaaggtggtactgcagccacaggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaacaccatcactcctgtagtgggtaagaagagaaaacgtaatacctcatctgataattcagatgtggaagtcatgcctgcacagtcacctcgagaagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatccttttcc

SEQ ID NO: 5893 - DNA, 7420 bp, Homo sapiens
tgctggagagacagggagaggggcgaaccggccccccacagccactgcaggagttccaccatcttcctctgaagacgtagccatcttgctccatgaagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggaccaggacaaagcccaggacaaagactttcagtaccagtcaaggtggtactgcagccacaggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaacaccatcactcctgtagtgggtaagaagagaaaacgtaatacctcatctgataattcagatgtggaagtcatgcctgcacagtcacctcgagaagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaaggaaaaaaaaaaaaaaatgtacctgattgctcccaattatgagaggattgggtgggcaggggaactcctaaaataatacatgaccacttcctcatttctggggaaggaaaggagactagagcagctggtgtgctcacccctccctagtcacctccattaaccacagactatgtagcgctggccctagcctctggcagagcctgttcctggccgaactgtggatacagctggagggtcaggaactgttaccttctttccccttggcattaataaatttaagttaatccttttcca

SEQ ID NO: 5894 - DNA, 8137 bp, Homo sapiens
agggtgagttgaaacgctgcctggaaaggaagtaccaggacttgcacaggagttccaccatcttcctctgaagacgtagccatcttgctccatgaaggtcaggacaatctgacatgcacttgtttcttgcctctatacttgaagagtagtcctcttacattgtgtacatttttttcttaataggggaggggaggggagagccagtaccccccctccccttccctccctagaccttggagaagtaccctccattactttcccaagatggcagaccccatcatggatctgttcgatgacccaaatttatttggcctggactctctgactgatgacagctttaaccaggtcacacaagaccccattgaggaagcccttggactgccaagctctctggactccttggatcagatgaaccaggatggtggaggtggtgatgtggggaattcatcagcaagtgaactggtccctccaccagaggaaacagctcccacagaactttccaaagaatccacagctccagctccagaatccataaccttgcatgattataccactcagcctgccagccaggagcagccagcccaacctgtcttacagacatcgacgccaacatcaggacttttgcaagtctccaagagccaggagatcctgagccaagggaatcctttcatgggtgtctctgccacagctgtctcctccagtagtgctggagggcagccacctcagtcagcccctaagattgttatccttaaggccccaccaagctcctcagtcactggtgcccatgtggcacaaattcaggcccaaggtatcaccagcacagctcagcccctggtggcaggcacagccaatggtggaaaagtcacttttaccaaagtgctaaccggcacaccccttcgaccaggtgtttccattgtctctggtaatacagtgttggccgccaaggtccctgggaaccaggctgctgttcagcgcattgtccagcccagccgaccagtaaagcagctggtcctccagccagttaagggttcagctcctgctggaaaccctggggccacagggcccccactgaagcctgcagttacactgacctctacacctacccagggtgaatcgaaacgcatcaccctggtcctccagcagccacagtctggaggtccccaaggacatcggcatgttgtgctagggagtctaccaggcaagatagtgttacagggcaaccagctggcagccctgactcaagccaagaatgcccaagggcagcctgccaaggtagtaactatccagctgcaggtgcagcagccacagcaaaaaatccagattgtaccacaaccaccatcatcgcagccacagccccagcagccaccctccacccagccagtgactctgtcctctgtacagcaggctcagataatgggaccaggacaaagcccaggacaaagactttcagtaccagtcaaggtggtactgcagccacaggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaacaccatcactcctgtagtgggtaagaagagaaaacgtaatacctcatctgataattcagatgtggaagtcatgcctgcacagtcacctcgagaagatgaagaaagcagcattcagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggagaatcccagtgaagaagatgcagccattgtagacaaagtgctttctatgcggattgtgaagaaggagctcccttctggacaatatactgaagcagaagaattctttgtcaagtacaagaactactcctatctgcattgtgaatgggctactatctcccaactagagaaggataagaggatacatcaaaaattaaagcgcttcaaaaccaaaatggctcagatgagacacttcttccatgaggatgaagagccctttaatccagactacgtagaggtggataggatattggatgagtctcacagtattgacaaggacaatggggagcccgttatttactacctggtgaaatggtgctctctgccctatgaggatagcacatgggagctaaaagaagatgttgatgagggcaagattcgagaatttaaacggattcagtcaaggcacccagaactcaaaagggtgaatcgtccgcaggcaagtgcctggaagaaattggagctatcacatgaatataaaaacagaaaccagctacgggaatatcagttggaaggggttaattggctgctctttaattggtataacaggcagaactgcatcctggctgatgagatgggattgggcaaaactattcagtccattgccttcttgcaggaagtatataatgtgggcatccatggtcccttcttggtcattgccccactgtccacaattactaactgggagcgagaatttaatacatggacagaaatgaacactattgtgtaccatggcagtctggccagcaggcagatgattcaacagtatgaaatgtactgcaaagattcacggggacgcctcatcccaggcgcatacaagtttgacgctctgatcaccacttttgagatgattttgtcagattgtcctgagcttcgtgaaattgaatggcgttgtgttatcattgatgaagcccatcgactgaaaaaccgtaattgcaagctgcttgatagtctcaagcacatggacctggaacacaaggtgctactcacaggaacaccattgcaaaatactgtagaagaactgtttagcttgcttcatttcttggaaccgtcacaatttccctcagaatcagagtttctcaaggactttggggatctcaagacagaggaacaggttcaaaagctacaggccattcttaagccaatgatgctgagaagactcaaagaggatgttgaaaaaaacttggcacccaaacaggaaacaattattgaagtagagctgactaatatccagaagaaatactatcgggctattttggagaagaatttctccttcctttccaaaggggcaggtcataccaacatgcctaatctacttaacacaatgatggagttgcgcaagtgctgcaaccacccatatctcatcaatggtgctgaagaaaaaatcctaacagaattccgtgaagcttgccatattatacctcatgactttcacctgcaggccatggttcgttcagccggcaaactggttcttattgacaagttgcttccaaagcttaaagctggtggccataaagttctgatcttctctcagatggtgcgctgcctagacatcctagaggattatttaatccagaggaggtacttatatgaacgtattgatgggcgagttagaggcaaccttcgacaggctgccattgaccgcttcagcaagcctgactcagaccgctttgtcttcttactgtgtacccgggctggtggacttggtattaatcttacagctgctgatacctgcatcatctttgattcagactggaatccacaaaatgacctgcaggcccaggcacgatgtcatcgaattgggcagagcaaagctgtgaaggtgtaccgcctcatcactcgtaattcctacgagagagagatgtttgataaggccagcctcaagttggggttggataaggctgtgcttcaatccatgagtggtcgggatggcaacattactggaatccaacagttctctaagaaggagattgaagatcttttaagaaaaggagcatatgcagccatcatggaggaagatgatgaaggctccaagttttgtgaagaggacattgaccagatcttgttaagacgaactacaaccatcaccattgaatctgaaggaaaaggttccacctttgctaaggcaagctttgttgcttctgaaaacaggacagatatttctttggatgaccccaacttttggcaaaagtgggccaaaaaggctgacctagacatggatctgctcaacagcaagaataatttggtaattgacacacctagagtacgaaaacaaacgcgccactttagcactctgaaagatgatgacctggtggaattctctgatttggaaagtgaggatgatgagcggccacgctcccgcagacatgaccgtcatcatgcctatgggcgcactgactgctttcgggtggaaaagcatctcctggtatatggttggggacgatggcgagatattttatctcatggacgcttcaagcgacgtatgactgaacgagatgtggagaccatttgtcgggccattctcgtgtactgtcttctacactaccgtggggatgaaaatattaaaggcttcatctgggacttgattagcccagctgaaaatggcaagacaaaagaattgcagaatcattcaggtctatctatccctgtgcctcgtggacgcaaaggaaaaaaagtaaagtcacaaagcacttttgatatccataaggcagattggatccggaaatataaccctgacactttgttccaagatgaaagttataagaagcacttgaaacatcagtgtaacaaggtactgttgcgggtacgaatgctatactacctgaggcaggaggttattggagaccaagcagaaaaggtgttagggggtgcgattgccagtgagattgacatatggttcccagtagtggatcaactggaggttccaacaacttggtgggacagtgaggctgacaagtcgctgctcattggagtctttaaacatggctatgagaaatataataccatgagggcagacccagccttatgtttcctagaaaaggctggccgaccagatgacaaagcaattgcagcagaacatcgagtgttggataacttctctgacatagtagaaggggttgactttgataaagattgtgaagatcctgaatataaaccactccaaggtcccccaaaggaccaagatgatgagggtgatcccttgatgatgatggatgaggagatctcagtgattgatggagatgaagcccaggtgacccaacagccaggccatttattctggcctccgggctctgccctaacagctaggcttcggcgtctagtaacagcgtatcagcgcagctacaagagagaacaaatgaagatagaggctgcagaacgtggggaccggcgaaggcggcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggtgagccaaacagactgcaacatcatgcaggacccagacttctcttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatgaggatgattcggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcaggaaagacaaagagcctctgagtggcccaaggatcgtgtcctgataaaccgtattgacctcgtctgccaggctgtactctcagggaagtggccttctagccgtaggagccaggaaatggtaacaggaggaattttggggccaggcaaccacttgctagacagtccctcattgactcctggagaatatggtgactctccagtccccacaccacgaagtagtagtgcagcttccatggcagaggaggaagcatctgcagtcagcacagcggcagcccagttcaccaaacttcgccgaggcatggatgaaaaggagtttacagttcaaatcaaagatgaggaaggattgaagttaacattccagaagcacaagttgatggcgaatggagtaatgggagatggacatccactgtttcataagaagaaggggaacagaaagaagctagtagagctggaggtggagtgcatggaagagcctaatcaccttgatgtggacctggagacccggatccctgtcatcaataaggtggatggtactttgctggtgggtgaggatgcccctcgccgggctgaactggagatgtggttacagggtcatccagagtttgctgttgatccccgatttctagcgtatatggaggatcgcagaaaacagaagtggcaaagatgtaaaaaaaataataaggcagaattgaactgtttgggaatggaaccagtacagacagctaactctagaaatgggaaaaagggtcatcacactgaaacggtgttcaaccgggttttgccagggcctattgcaccagagagcagcaagaagcgggcccgtaggatgcgaccagacctttctaagatgatggccctcatgcagggtggaagcactgggtctctatctctgcataacacgttccaacacagcagtagtggcctacagtctgtgtcatctttgggtcacagcagtgccacttctgcatctttgccttttatgccatttgtgatgggtggtgcaccatcatcccctcatgtagactccagcaccatgcttcatcaccaccaccaccacccccacccccaccatcaccaccatcaccatccaggcttgagagcccctggctacccctcttcaccagtgactaccgcctctggtactaccttgcggttgccaccactgcaacctgaggaggatgacgatgaggatgaagaagatgatgatgacttatctcagggctatgatagctcagaaagggacttctcactcattgatgatcctatgatgccagctaactcagactccagtgaagatgctgatgactgaagccccagcatgggccccattgcttgggcggctgctgtattttcatttactctggcccttggactatggaaacgtgggaggggcaggggagatgtggggaagtccaggactccaggaggtgaaaagg

SEQ ID NO: 5895 - DNA, 3419 bp, Homo sapiens
ggagagaggacctatttctacctaaggacattcccggaaggcaatgggtttcaaacaatatcctgaagagactcatctcggggaactaagcaggtggtcatcagagaacacagagcccccggaagaattttatgacatttcaggcaagccacaggtcagcctggggaaaaagcaggaagaaaaactggcaatacgagggcccaacccaaaagttattcctgaagagaaacaacgtgtcagcaccagatgggccttcagaccccagcatctccgtgagcagtgagcaaagcggggcacagcagcctcccgctttacaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtattagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacattt

SEQ ID NO: 5896 - DNA, 3241 bp, Homo sapiens
ggttaaggagggaggggaaacaaaagcagtgtgctccaccaggctcctgcctcggctctaaggaaacagaggaaagcaaacgggaatactctggtttagtatactgcccgcttctggagtggacattgatttaaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtattagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacatttgaaa

SEQ ID NO: 5897 - DNA, 2184 bp, Homo sapiens
cggagaggggagccgcgatccggccgcgccgcccgcacgccgccgcgcccgccccagcccgcccggccccgcggcggggcgcgatgagcccgagcgcgagccggcccgccggggagtgagcgcggggcgcccagggcgcgttgcgtagctgctcctgcgcacaaccccgccgcgccgccggcccgcactggccgcggagtgcaagaggctcgtccgtgcccagcgcccggccggccgcgggagcaggaagcgcaggccacgcaggacccaactgaaacaaagtgtcggccgcccggcgccggcgcccgccccgaccctgcccctcccgcccgcaactccgccgcccaccatggcttccgaggagctgtacgaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagct

SEQ ID NO: 5898 - DNA, 2139 bp, Homo sapiens
actgtctggcactccctagtgagatgaacctggtacctcagatggaaatgctgaaatcacctgtcttctgcgtcgctcacgctgggagctgtagaccggagctgttcctattcggccatcttggctcctccccaaggcttaggtttctaagtcagccacaaatgctacccaaaactacataaagaagaaaaaagttgcatagaaccaaaaagttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtat

SEQ ID NO: 5899 - DNA, 2321 bp, Homo sapiens
ctgtggatttagctactctcacctgaggctactgagcaagttgtcatgcaccatgagacaaagcccaagctgtcccaccaggcagtaagtatggagaggttcaggcacatggcatagctgctatttcgcacaattttcactacaccagtggtgacaaaatagaagaggttcatccatacacagaacctggtgaagagctggaggcagaaagaagtgtctatgtggagacgcaactgaaacaaaggtggcacagcaactgttccaatcccgtgtctttcctcatggcttcccaggagtttgaggttgaagctattgttgacaaaagacaggataaaaatgggaatacacagtatttggttcggtggaaaggttatgacaaacaggatgacacttgggaaccagagcagcacctcatgaactgtgaaaaatgtgtacatgattttaatagacgacagactgaaaaacagaaaaaactgacatggactacaaccagtagaattttttcaaacaatgccagaagaagaacttccagatctacaaaagcaaactattctaagaactctcctaaaacgccagtgactgataaacaccacaggtccaaaaaccgcaagttatttgctgccagcaagaacgttaggagaaaggcagcttcaattctctccgacacaaagaatatggagataataaattcaactattgagacccttgcacctgacagcccctttgaccacaaaactgtgagtggctttcagaaacttgagaaactggaccctattgcagcagatcagcaggacacggtggtcttcaaggtgacagaagggaaactcctccgggaccctttgtcacgtcctggtgcagaacagactggaatacagaacaagactcagatacacccactaatgtcgcagatgtctggctcagttactgcttctatggccacaggttcagctacccgaaagggtatagtggtattaatagacccattagcagccaatgggacaacagacatgcatacctcagttccaagagtgaaaggtgggcaaagaaatattactgatgacagcagagaccagccttttatcaagaagatgcacttcaccataaggctaacagaaagtgccagcacatacagagacattgtagtgaagaaagaggatggattcacccagatagtgctatcaactagatcgacagaaaaaaatgcactgaatacagaagtaattaaagaaatagttaatgctctgaatagcgctgctgcagatgacagcaagctcgtgctgttcagtgcagctggaagtgtcttttgctgcggtcttgattttgggtactttgtgaagcacttaaggaataacagaaacacagcaagccttgaaatggtggacaccatcaagaactttgtgaatacttttattcaatttaaaaagcctattgttgtatcagtcaatggccctgcgattggactaggtgcatccatcctgcctctttgtgatctcgtgtgggctaatgaaaaggcttggttccaaaccccttatacgacctttggacagagtccagatggctgttcttctattacattccccaaaatgatgggtaaagcatctgccaatgaaatgttaattgctgggcgaaagctgacagcaagggaggcatgcgccaaaggcctggtctctcaggtatttttgactggaactttcacccaagaggttatgattcaaattaaggagcttgcctcatacaatccaattgtactggaagaatgtaaggccctcgttcgctgtaatattaagttggagttggaacaggccaatgagagagagtgtgaggtgctgaggaagatctggagctcagcccaagggatagaatccatgttaaaaatacctctgttgggatataaagcagccttccctcccagaaagacacagaatgatcagagatggtgcccttgactttatagtggcacaaacgcttcagagacacacaattataagagacttatcttttagcataaatacttatggctcaaaatccactgacgatcattctcctaaactgaacacatgactagaattggtggtgagatatcgcttgattttcttttcctttataaatgtctagttcttacccagttaacaaaagaaaactttatcgctctaaagtaaaacttgttacaccacattagtgaattatggaatgattttggtggaaatatccaggttctaatgtgtggaatgtgcagatttaggttactttagtgtatgttctagttaataagttaaaattctggacacattattaaaggcagaaacttctttcaaagcaaa

SEQ ID NO: 5900 - DNA, 2220 bp, Homo sapiens
aacaggcaggaagaaagctttctgtactacaccagagggttggggctgtggatttagctactctcacctgaggctactgagcaagttgtcatgcaccatgagacaaagcccaagctgtcccaccaggcagtaagtatggagaggttcaggcacatggcatagctgctatttcgcacaattttcactacaccagtggtgacaaaatagaagaggttcatccatacacagaacctggtgaagagctggaggcagaaagaagtgtctatgtggagacgcaactgaaacaaaggtggcacagcaactgttccaatcccgtgtctttcctcatggcttcccaggagtttgaggttgaagctattgttgacaaaagacaggataaaaatgggaatacacagtatttggttcggtggaaaggttatgacaaacaggatgacacttgggaaccagagcagcacctcatgaactgtgaaaaatgtgtacatgattttaatagacgacagactgaaaaacagaaaaaactgacatggactacaaccagtagaattttttcaaacaatgccagaagaagaacttccagatctacaaaagcaaactattctaagaactctcctaaaacgccagtgactgataaacaccacaggtccaaaaaccgcaagttatttgctgccagcaagaacgttaggagaaaggcagcttcaattctctccgacacaaagaatatggagataataaattcaactattgagacccttgcacctgacagcccctttgaccacaaaactgtgagtggctttcagaaacttgagaaactggaccctattgcagcagatcagcaggacacggtggtcttcaaggtgacagaagggaaactcctccgggaccctttgtcacgtcctggtgcagaacagactggaatacagaacaagactcagatacacccactaatgtcgcagatgtctggctcagttactgcttctatggccacaggttcagctacccgaaagggtatagtggtattaatagacccattagcagccaatgggacaacagacatgcatacctcagttccaagagtgaaaggtgggcaaagaaatattactgatgacagcagagaccagccttttatcaagaagatgcacttcaccataaggctaacagaaagtgccagcacatacagagacattgtagtgaagaaagaggatggattcacccagatagtgctatcaactagatcgacagaaaaaaatgcactgaatacagaagtaattaaagaaatagttaatgctctgaatagcgctgctgcagatgacagcaagctcgtgctgttcagtgcagctggaagtgtcttttgctgcggtcttgattttgggtactttgtgaagcacttaaggaataacagaaacacagcaagccttgaaatggtggacaccatcaagaactttgtgaatacttttattcaatttaaaaagcctattgttgtatcagtcaatggccctgcgattggactaggtgcatccatcctgcctctttgtgatctcgtgtgggctaatgaaaaggcttggttccaaaccccttatacgacctttggacagagtccagatggctgttcttctattacattccccaaaatgatgggtaaagcatctgccaatgaaatgttaattgctgggcgaaagctgacagcaagggaggcatgcgccaaaggcctggtctctcaggtatttttgactggaactttcacccaagaggttatgattcaaattaaggagcttgcctcatacaatccaattgtactggaagaatgtaaggccctcgttcgctgtaatattaagttggagttggaacaggccaatgagagagagtgtgaggtgctgaggaagatctggagctcagcccaagggatagaatccatgttaaagtatgttgaaaataaaattgatgagttttaattgtcagtctgtctgctcaggacacaagaactaaggggcaacaaatgcatcatgagttgcaagatgccctaatccatcttcatagcccaaaacaatttcacccatagctaaggcttggaaacagaactggaaatgtccaagctatgtatttaaattatcacatcatttttaagcactgtagctttacaaggagtaacaaaacagcctctttgcccaaatgtgattattttatgcacacctaagcccaaatataaaaacagactcttcttgc

SEQ ID NO: 5901 - DNA, 2063 bp, Homo sapiens
aagggggcggcaccgctgacgtcatttccggggtcggggtatataagcggggcgcgagggcgctgctgctgccaccgctcctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaagcagagctggagaaagtggcccaccagctgcaggcactacggcggggctgagacaccggctggcagggctggccccagggcaccctgtggccctggctctgctgtccccttggcaggtcctggccagatggcccggatgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttcctctgaa

SEQ ID NO: 5902 - DNA, 1474 bp, Homo sapiens
cgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaaggtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaagcagagctggagaaagtggcccaccagctgcaggcactacggcggggctgagacaccggctggcagggctggccccagggcaccctgtggccctggctctgctgtccccttggcaggtcctggccagatggcccggatgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttat

SEQ ID NO: 5903 - DNA, 2550 bp, Homo sapiens
ccgctcctggctgcccgctcctcccggccctgcggcccccgcctgccctttaaaagagcggggcctgcgccggccgcgccacaccgcggggaccaggaggcacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggctgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggagacagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctgactgtcattggagcggtgggcactgttaagaagcagccatcacatgatctgtttttcaccacttcactgaaagacaccatttatctacccaagggcagaaagtagaacttactattcattaaatgtttgacacaattggaattgtctttaatttctgtcagaatgctattgaaaatgtgaattgcatgacttgtagcatattcttttctgcaaaatagacatattaacatgcttatgacaatgactgtgctactgtctttggaaaaatgtttgtctcagttggaaataataaaagattcacctgagaccaaaa

SEQ ID NO: 5904 - DNA, 1129 bp, Homo sapiens
cacgctggttttccggggccgctccatcgcgccttcctcctgcgcctcgcttctccggtccagccgccatcttcctttccgcacaggggccgccgagcggggccatgcagccaacgctgcttctcagcctcctgggagccgtggggctggcggtcatttatttgcagaagatattacagatttccagcggaaagagaaagtgctgaaatgggtgtgttctcaagtagccatttggaggatgaaagaacactgtcaattccatgccagtggataacaggaaccacaatgaaggaatggtgactcgctgcatcattgaggtcctctcaaatgccttgtcgaagtccagcgctccacccatcacccctgagtgccgccaagtcctgaagacgagtagaaaagacgtcaaagacaaagagacaactgaaaatgaaaacacaaagtttgaagtaagattgttaagagacccagctgatgcctcggaagcccacgagtcctccagcaggggagaggcaggagccccaggggaggaggacatccaaggcccaacaaaggcagacacagagaaatgggcagagggaggcgggcacagccgagagcgagcggatgagccccagtggagcctctatccctccgacagccaagtctctgaagaagtgaagacacgccattctgagaagagccagagagaggatgaggaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggagacagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggagga

SEQ ID NO: 5905 - DNA, 5493 bp, Homo sapiens
gtgggggccaggcagcacagatgaagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggaggcccggcttgggacattgttcacttcccctcgcttcccctctagaagccccctttgccatccctgcaccttgtttcgggtgatgcccgagagggagctgtggccagcggggactggctcagaacccgtgacccgtgtcggcagctgtgacagcatgatgagcagcacctccacccgctctggatctagtgatagcagctacgacttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggaggtccagaggagaccatcactcagcaaggacgaacgccaaggacagtaactgagtccagctcatcccaccctcctgagccccagggcctaggcctcaggtctggctcctacagcctccctaggaatatccacattgccagaagccagaacttcaggaaaagcaccacccaggctagcagtcacaaccctggagaaccggggaggcttgcgccagagcctgagaaagaacaggtcagccagagcagccaacccaggcaggcacctgccagcccccaggaggctgcccttgacttggacgtggtgctcatccctccgccagaagctttccgggacacccagccagagcagtgtagggaagccagcctgcccgaggggccaggacagcagggccacacaccccagctccacacaccatccagctcccaggaaagagagcagactccttcagaagccatgtcccaaaaagccaaggaaacagtctcaaccaggtacacacaaccccagcctcctcctgcagggttgcctcagaatgcaagagctgaagatgctcccctctcatcaggggaggacccaaacagccgactagctcccctcacaacccctaagccccggaagctgccacctaatattgttctgaagagcagccgaagcagtttccacagtgacccccagcactggctgtcccgccacactgaggctgcccctggagattctggcctgatctcctgttcactgcaagagcagagaaaagcacgtaaagaagctctagagaagctggggctaccccaggatcaagatgagcctggactccacttaagtaagcccaccagctccatcagacccaaggagacacgggcccagcatctgtccccagctccaggtctggctcagcctgcagctccagcccaggcctcagcagctattcctgctgctgggaaggctctggctcaagctccggctccagctccaggtccagctcagggacctttgccaatgaagtctccagctccaggcaatgttgcagctagcaaatctatgccaatttctatccctaaggccccaagggcaaacagtgccctgactccaccgaagccagagtcagggctgactctccaggagagcaacacccctggcctgagacagatgaacttcaagtccaacactctggagcgctcaggcgtgggactgagcagctacctttcaactgagaaagatgccagccccaaaaccagcacttctctgggaaagggctccttcttggacaagatctcgcccagtgtcttacgtaattctcggccccgcccggcctccctgggcacggggaaagattttgcaggtatccaggtaggcaagctggctgacctggagcaggagcagagctccaagcgcctgtcctaccaaggacagagccgtgacaagcttcctcgccccccctgtgtcagtgtcaagatctccccaaagggtgtccccaatgaacacagaagggaggccctgaagaagctgggactgttgaaggagtagactctgcgaccagtacagaccctgtcctggctgaacaagaagagacacatgctccacttgggagcctttgccaccacgcaactcagggctcaagatgaatgggagggagagatttgagtccaagcatacatttatattcagtgttgtgccattgagttcccatgtggatcattctgaaggtgatctccacaagagggtgtgtgtgtgtgtgtttggtgtgtgtgtggagggggggccgctggatacatcactgaagctattgatataacacaatgagtcactgttcagaattttgctcttgttagatgttttcttacattgggtagagtccagcctagtgagagctgagtgaaggggctggccatgcctgagacaaaaagtcaaatgagacaatggacgtgtcaatgacttgaaaaaaagtcacatccagcaaatgcagggtcacatgaaatatgggcctcctggaatccctacagtggatggagactggctcataccttgccagatccctctctcagttccagccttctggacaaggcctgggctaagaggagctgattcgttatctcttcacccactgccctctcagtatcaccagtcccaaagacaggatacgtccctgtaacccaatctctcggttgattgatagcagaacagctcttgttggtctgagaaggcaggataagtgaccacatatttatgccactacctccaccagggagagtccttctccacaggcttgataaattcaatcaccaactgtgctgtcgtccctgactctgctactcccgttcttcctgctttcctgctccgtatctcagtctgcactgaccccagggctgggctgacatcaagatgggagcccagcccacgggctttataaacacccaagaaccgtttcagatcttctctgtgctgatgcaggtagttttaaatttttctcagttccagtgatagaaaacccacacaatacatcctctgccagtcttaatagaatatcagaggtaagaggggcctcagagaagctctgacgcagtgctgctggggaagggaagtgactaaccccgggtcagcctgccatttagggaaagagctgaggttcttacccttgttgcatgctgccacctctccttagccagtgctcttgtacatccacacagcaccctaaggagccatagtcaccatcaaagactcaaccctaaggcccttcaagatctcaaagtgccttctgaagcatcagagattaaatattgttcaaactaatagttattgctgtggcttttaattttatctttggaagatagctatatggtaactcatcattaaccagaacacctctcccctcaaattccgtgaccaagttgtgcagcttgagcaaatgccgaaagagggtattatgggtgggtggtgtgggcttgcaaatacaagcttggaggtgagacatggccagacatgactcctgcttccccttaggaagtaaatcttacttatggttgtgaactgcttggagtccaggatgcccagatgtgaggggcagatgaagggaatgttgctggaaaggtgccttttaaggctgctgagaatttctggactgtgtcctgatggacgcagcaccatcaaagcccagaatttctgaaaacggtgacaaggttaacataaggacaacaaatactccaccctgtcatggtatgtgaggtgtgggtgtggcggtttctgtgtacgtttgctcatacacgcacatccaaaagcctgtgcctcattcctggccatgggtgaggacttggtctgtcacggctgatgaggactcccacaaccggccaagttatgtcttattatacacccccagaaagagagaaagctgccttctggaggactgattccacatgctatattcagctgagttgatttctgtgtctatttcaacccataacctgaagaatgatcaccttattccttattcattaattttcttgattaatagggaaacttgggaatagctataaagtaaaacttgggtggaacctggggccctggcatcacacaagtgtgattaggatggtcaaggtcatcaggagtacagcctattatattcccacatcctgagaaaggtcatttctcccacacacgacaaagtcacagacatcctgcacctgccactaggcatcctcatcctactgacatgcccatttctccagttttcttaatctgagactcccttcccttgttttttaaagataccgtgcttctccacatcctcatccttcaaggagcatattttgctcttaggatggtctttgggattcaagaatagaataataaatccaaacttggtcattcccattttgaagagatgcaagagggcccagtgaggacatccgcctccctgaaagtggtgctagacagagctgaggtcattgtatctgtgtatccacataggatttctcttaattcagcttgaattgatggggagggaggtaagagtagggtcagagttactcatcccttttcaaagaattgtgggtggaagtttgtaaaggccattcatttgattttcaaaatcaaagcgacagctctacttccacttggccttagatctctgctataccctgccatagccttgatgccactgggcacaagccacctgccaaatacaggagtggcctctcccagcctggcatgataggggggtctgtgccctcagatgtgttgacagctgctcttctgaattgccacacctgtgctacacttggaattctgtgctctgactctgcagggtaggaccacgtgccatctcacacagaggtcaaccgatgagcccactcactcgtacatgccttcttccacagtgggaagcatgatctggcaggggccgccctgtaggctggggatgggctgctgtgtgaatgttgacgttcgtttcatggagaaaggggaggtgaaagattgaagagcaggttcctgtcaatgttctgagttcgagctggaggtgtagattgaatagtctacatggtctgtgagtgtgtgagatgaacccttccatcctttgacacctggttgtatgtgtaggctaagaaggaaggaccctcctgtcagtgtgcaaagctgtaatctcatggactagaggagagggggccaaggggatggacaggagaagtcatgcagaatctaagcaggaatgcagatagaacacatctaggctcttttccccaggagagtgatgatggagcatatagatctggctcaaattcagcctccatcacttaccagtcaggaaccctggcgatatcactttaactttctgaacctcagagtcttcacctataagacggggaaaataataccaccctttcaagattgttgagataaataagtgatataaaacatgtaaagcttagttctggccacagtgtagctactcaataaatgataatactacc

SEQ ID NO: 5906 - DNA, 3142 bp, Homo sapiens
agtggcagggtgggggccaggcagcacagatgaagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggagagtgatagcagctacgacttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggaggtccagaggagaccatcactcagcaaggacgaacgccaaggacagtaactgagtccagctcatcccaccctcctgagccccagggcctaggcctcaggtctggctcctacagcctccctaggaatatccacattgccagaagccagaacttcaggaaaagcaccacccaggctagcagtcacaaccctggagaaccggggaggcttgcgccagagcctgagaaagaacaggtcagccagagcagccaacccaggcaggcacctgccagcccccaggaggctgcccttgacttggacgtggtgctcatccctccgccagaagctttccgggacacccagccagagcagtgtagggaagccagcctgcccgaggggccaggacagcagggccacacaccccagctccacacaccatccagctcccaggaaagagagcagactccttcagaagccatgtcccaaaaagccaaggaaacagtctcaaccaggtacacacaaccccagcctcctcctgcagggttgcctcagaatgcaagagctgaagatgctcccctctcatcaggggaggacccaaacagccgactagctcccctcacaacccctaagccccggaagctgccacctaatattgttctgaagagcagccgaagcagtttccacagtgacccccagcactggctgtcccgccacactgaggctgcccctggagattctggcctgatctcctgttcactgcaagagcagagaaaagcacgtaaagaagctctagagaagctggggctaccccaggatcaagatgagcctggactccacttaagtaagcccaccagctccatcagacccaaggagacacgggcccagcatctgtccccagctccaggtctggctcagcctgcagctccagcccaggcctcagcagctattcctgctgctgggaaggctctggctcaagctccggctccagctccaggtccagctcagggacctttgccaatgaagtctccagctccaggcaatgttgcagctagcaaatctatgccaatttctatccctaaggccccaagggcaaacagtgccctgactccaccgaagccagagtcagggctgactctccaggagagcaacacccctggcctgagacagatgaacttcaagtccaacactctggagcgctcaggcgtgggactgagcagctacctttcaactgagaaagatgccagccccaaaaccagcacttctctgggaaagggctccttcttggacaagatctcgcccagtgtcttacgtaattctcggccccgcccggcctccctgggcacggggaaagattttgcaggtatccaggtaggcaagctggctgacctggagcaggagcagagctccaagcgcctgtcctaccaaggacagagccgtgacaagcttcctcgccccccctgtgtcagtgtcaagatctccccaaagggtgtccccaatgaacacagaagggaggccctgaagaagctgggactgttgaaggagtagactctgcgaccagtacagaccctgtcctggctgaacaagaagagacacatgctccacttgggagcctttgccaccacgcaactcagggctcaagatgaatgggagggagagatttgagtccaagcatacatttatattcagtgttgtgccattgagttcccatgtggatcattctgaaggtgatctccacaagagggtgtgtgtgtgtgtgtttggtgtgtgtgtggagggggggccgctggatacatcactgaagctattgatataacacaatgagtcactgttcagaattttgctcttgttagatgttttcttacattgggtagagtccagcctagtgagagctgagtgaaggggctggccatgcctgagacaaaaagtcaaatgagacaatggacgtgtcaatgacttgaaaaaaagtcacatccagcaaatgcagggtcacatgaaatatgggcctcctggaatccctacagtggatggagactggctcataccttgccagatccctctctcagttccagccttctggacaaggcctgggctaagaggagctgattcgttatctcttcacccactgccctctcagtatcaccagtcccaaagacaggatacgtccctgtaacccaatctctcggttgattgatagcagaacagctcttgttggtctgagaaggcaggataagtgaccacatatttatgccactacctccaccagggagagtccttctccacaggcttgataaattcaatcaccaactgtgctgtcgtccctgactctgctactcccgttcttcctgctttcctgctccgtatctcagtctgcactgaccccagggctgggctgacatcaagatgggagcccagcccacgggctttataaacacccaagaaccgtttcagatcttctctgtgctgatgcaggtagttttaaatttttctcagttccagtgatagaaaacccacacaatacatcctctgccagtcttaatagaatatcagaggtaagaggggcctcagagaagctctgacgcagtgctgctggggaagggaagtgactaaccccgggtcagcctgccatttagggaaagagctgaggttcttacccttgttgcatgctgccacctctccttagccagtgctcttgtacatccacacagcaccctaaggagccatagtcaccatcaaagactcaaccctaaggcccttcaagatctcaaagtgccttctgaagcatcagagattaaatattgttcaaactaa

SEQ ID NO: 5907 - DNA, 7346 bp, Homo sapiens
acatcctccggctgcccgcgcacctctccacgccggccccgttccgcggctcgccctcggctgcgctcggctcccgcgggcgctcggccccgagcccctcctccccctacccgccggccggacagggaggagccaatggctgggcctgccatccacaccgctcccatgctgttcctcgtcctcctgctgcccctggagctgagcctggcaggcgcccttgcacctgggacccctgcccggaacctccctgagaatcacattgacctcccaggcccagcgctgtggacgcctcaggccagccaccaccgccggcggggcccgggcaagaaggagtggggcccaggcctgcccagccaggcccaggatggggctgtggtcaccgccaccaggcaggcctccaggctgccagaggctgaggggctgctgcctgagcagagtcctgcaggcctgctgcaggacaaggacctgctcctgggactggcattgccctaccccgagaaggagaaccgacctccaggttgggagaggaccaggaaacgcagcagggagcacaagagacgcagggacaggttgaggctgcaccaaggccgagccttggtccgaggtcccagctccctgatgaagaaggcagagctctccgaagcccaggtgctggatgcagccatggaggaatcctccaccagcctggcgcccaccatgttctttctcaccacctttgaggcagcacctgccacagaagagtccctgatcctgcccgtcacctccctgcggccccagcaggcacagcccaggtctgacggggaggtgatgcccacgctggacatggccttgttcgactggaccgattatgaagacttaaaacctgatggttggccctctgcaaagaagaaagagaaacaccgcggtaaactctccagtgatggtaacgaaacatcaccagccgaaggggaaccatgcgaccatcaccaagactgcctgccagggacttgctgcgacctgcgggagcatctctgcacaccccacaaccgaggcctcaacaacaaatgcttcgatgactgcatgtgtgtggaagggctgcgctgctatgccaaattccaccggaaccgcagggttacacggaggaaagggcgctgtgtggagcccgagacggccaacggcgaccagggatccttcatcaacgtctagcggccccgcgggactggggactgagcccaggaggtttgcacaagccgggcgatttgtttgtaactagcagtgggagatcaagttggggaacagatggctgaggctgcagactcaggcccaggacactcaaccccaggaggggagccgctcggcgaatgagctgggtgggtgcccaggagccggcccgcagcacctgcacacacgaagtccggacccacgcagcctccatcccgcgtgtcttgctctccgcgatggcaatgccgagagtgccctctactgtccgactccagcactgcaacagcttcaagttcaaaaccaagaggcgtttttgagagtggaaaagaaatttaaacttcccgaaagaaggtccaccatcaggagatgaatatggaacatctcctatgtaccaggcactgtgctaagtgctggaatacattatctcattgaattatcacaacgaccttttcaagtaggcattatcaccatgcgacaggttgaggaccgtgaggcacgctggagttatttgactcgacttgcccagggtcccaggtcagtgctcctcaaacctgaacatgctaagagtcacctggaggtccagttaaaaatgtacatctggccgggcgcggcggctcacgcttgtaatcccagcactttgggaggccaaggcgggtggctcacctgaggtcaggagttcgagaccagcctggccaacatggggaaaccccgtctctattaaaaatacaaaaattaggccaggcgcggtggtgcacacctgtaatcccagctactcggaggctgaggcaccagaatcgcttgaacttgggaggcagaggttgcagtgagcagagatcgtgccactgcactccagcctgggggacaagagtgaaactccatctcaaaaaaaaaaaaaaaaaaaagcacatctgactcagtgggctctgtgctctaacaagctcccagggaacgcgaggctgctggcccagggacccactgagaggtcctgggaagtacatggcagagcaaggacatgaacctgggccaaggctgtccagctccaaggcccacgttcttgctgctccacagccaagaatttcttccagattctctaaggcttttggcaagagaggctcacaccctggtattcccttcctctgtggctggaataacttgactgttctctgccttccctggataaaggtgtatcatgtttaaaaacaaaacaaaatacaacttaagcacatacttgcttgcaggaataagttgggcaggttgatccctgtggtctagtagctgatatcctgggataagaagtgtttggggaaaagaatcatgttggcctttatgtccctgtggtcctgatcatccagtcctggacaggcactttacagttttctggagcacttcccccccaggggttctgatgcaagcatggaatccaaaaaaaccccacacatattgcccatgtttacccactttgcatactgtttagtgatttccaggaccacaaaaccatccctggaaccccaccccacatttttgcagcagagcccactgggaagttgaggctcacctgaaattgaggtgctatctgaagctaactgcccctaacaggccagactcacaatgcccacccaggacatctgtcccagcagatctggcttcaggggtcacttcaggagaaccatttaaatccccccacttggcatctcactcctggccaaccctctgttccagggcgaaccaggttgcaaatgacaaaagactttcctggccaaattcctcactggcctggatcacgcccataagatgccagagatgtttactgcgttggaaaaatcagtcggggtcaggggtcaggcaccaaggaaagcaggcagatctagaagaaattaaatatgcttgttctctccctatccaagtttgatgggcatgggaaccttgtggggagggagcagggagggcaggggaactgggagatcaaagcaggctagctgaaaggcagatatggctagacacaatggctcatgcctgtaatcccagcactttgggaggctgaggtgggcggaccacctcaggtcaggagtttgagaccagcctggccaacatggcaaaacccggtctctaccaaatatacaaaaattaaggctgggcacgagggctcatgtctgacatcccagcactctgggaggccgaggtaggcagatcacttgaagtaaggcgttcgagaacagcctgaccaacatggtgaaaccccatctctactaaaaatacaaaaattagccaggcatggtggcaggtgcctgtaatcccagctactcaggaggctcaggcgggagaatcacttgaacccaggaggcggaggttgcggtgagccaagatcacgccattgcactccagcctgggcgacagagtgagactccaaaaatataaaacacttaaaaatgtaaaaaggcagatctgccagcagcttcgtacttgagaccagacaacccacacatgctgtgtgtgcctcacattaagtggtgactcgggactgtgctggctctgtggggctagaaccctaaggagtaccgccggaagaaagcccagcattactatggctgggggacagctgttagatggtcctaggacatcagccatggagaacacagagggtcaggacaaagctaaaatgcccatagaactgccactggttgccagggtagttccatggttggaaattcaaggcccgtctctttgccctagctatctctatttgacatttccaaagagggatgggtggatggaacctcttaactccagagctgggaatcccaaagccctctcaagtgtctaaccaacctctctgccaggaagttcttccttaggtctatcttaaatttattttgctcatacagaagccagtttcctctaatccagggtttagcaaacttttactgtgaggagccaaataaacattttaggatttgcaagccatctgatctccaccagctactcagctctgccgtagctcgaagcagccacagagagtgtgtaaatgaattcatggctatgctccaggaaaactatttctggacacacatgtgaattctgtatacttttcacatgtcacaaaatattattctctctttccttttttttttttttggagatggagttttgctctgctgcccaggctggaatgcagtggctcagtctcagctcactgcaacctcttcatcccaggttcaagcaattctcctgcctcagcctcccaagtagctgtgactacaggcatgtgccaccacacctggttaatttttgtatttttagtagagataaggttttaccatgttggccaggctggtctcaaacttctgacctcaggtgatccgcccgcctcagcctcccaaaatgctgggattacaggtgtgagccaccgcacctggccataaaatattattagtttaattttctaaaaccatttaaaagtgcaaaaactgctctttgcttgccaactgcgcaaaaccaggcagtggggcagatttggcctgagggtcacggtttgccaacccctgctcaagcctgctcactctcaacgctggctgcacgttgcaataatccaggaacattcacaggcctggggcccacccacaaagcttctgttttgtttggtctgggcttcatagtttttctcccaggtaacttcaggtgcagctggggcggagagtctctgctctccccttccatctgtagcagtgtggctggtgttaaatccacctattccacctctcacagctttggcaaccttaggaaagtttcttaaggtctctgtgccttgattttttcatctgtaaaatgggaataataactctcccttcatagggttgttgtgagtagtgaatgcatacttctttttttttttttttcttttgagacagagtttcactcttgttgcccaggctggagtgcagtggcacgatctcggctcactgcgacctctgcctcctgggtacaagtgattctcccgcctcagcctctcgcgtacctgggattataggcaagcatcaccacgcccggttactgtttgtatttttagtagagatggggtttcaccatgttggccaggctggtctcaaactcctgacctcaggtgatccccccgtctcagcctcccaaagtgctgggattacaggcatgagccagcatgcctggcctgtgaacgcagaattcttataaggtgtttagaacagtgcctagcacctaataaacctccagtgttagctaatttgttattctaggagaattttagatgtcggttctttgacaatgacccatcacatactctgagatcatttctaagtcaccattcaagctccttccccaaagtgtgttccatagaacactgggaccatgagatgctctattagaaagggtcagggtacggttccatggtcagagaggtttggaaaactgttctggcctcagcccttggcagcatgtgcagattccaggcaccgaggcagggctggaggagtaagtggctttgcaataaaatgggtgctggagtctaaaatgataccctgggtggagtgggggagctgagcaggaggccaggtggcaaccagtagctgctgggcccgtggcctgaaccctcctgcactcctccagctggagtctcaccgcggatcccaggaatacctgctgttcccacagggctgcctttccgtagtttgtctggagacaccaagagtggtttccatgcctgctgggaataggctgagcatgcaatgacatgagggccaaggcttgtgggaaaatgacagcttcacagccccttgaggagtgaccaagccacaaagtaaatcctaaagccacaaccccttctaccactgagctgctggaggtgggtccttatttcaagccatattcaacccacccaacaaaacctaacattgaggtggtgggcacacggcccctgccgtggggctcactctgcagctggagagacagcatacctgaaacctgcaaggaaccggtttataaaacaacagaacagccaggaaaatggtgctaggagagacagtggagaggccagagaagcaaaccactgtggctcctcactgggggtttcacggggttggactgagccctgtcacctctgtgatagtcttcactctgacaggcaatggtgactgtgtgtgtttcctggggaggaggttagcagggacggttgcctttcctgggaagggcagtttgcagaaccaggggtttatattgcagggagtgtattttctgaattctaagtcagaacaagcagtctgatacaggatccatggctgggtcacttctgggtgcaagaggctttctagaccttagacactcaagattacggtcccgggccagtaacagcacctgggagcttggtagaaatgcagaatcttagcctaggcaacatagggagacctcatctctgcaaaaaataacaaaattagccgggcatggtggtgcacacctgtagtcccagctattctccaggctgaggtgggaggatcgcttgagcccaagaggttgaggctgcagtgagccatgatcgcaccactgcactccagcttaggcaatacagcgagaccttgtctcaaaaaaagacaaaaaaaacaaaaagaaatgtagattcttgggccccaccaccccacgcctactgagccagaatctctgggggtggggcccagccatttggcttttcacaagttctccaggtcattcttgggcacgatcaaatttgagaatcacaggtctaggatacgacggggaaaacagaaatgtggggtggtcagggacattcggataattcgggctatttgtattcaggtgtgagctggcaaatccgagacctgttttgcgtagctaattaccagcaatgacaaactcccaggctctgaggcccaagcctcctgggctgcaactggtctttatttttggaggcaatgaatggagcacctcggcctgggaccctcagtgtagggttttctgactcttaggcaacttcctagggtgctgtacttcctttttaaagttggggagcggcagggggagggggaagtgccacgcccttgtagtttcatgatgtcatgttgcatgtgctcttgagctgtaaataaagagacgatggttaaaaagcc

SEQ ID NO: 5908 - DNA, 746 bp, Homo sapiens
gcagtacacaagtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatgaaatgacacctcatgcaggcaggtaccagaaagtaagtcctcagcaggaaaaacacaaacaaaattttgctccatttaatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctgggtctgtgggtttctgttggg

SEQ ID NO: 5909 - DNA, 2627 bp, Homo sapiens
ccttacttgctggtggcccagacttcgggacattctgaacctcactgtccttccctctacaacagcgcattcctcttggcccagcttccaaagctatttgccgccccgtcaaccctgcagcccctacagccgcgaatccaggaaaccctctacccgcagcccagctactgagtttacaatcccctgggctttgggctccaaggtgcgggttcctgccccagtagtggctcggtggacgccccaacttgccgcgcaggcgcgctcgggccctctccccctccccgcgctccgcagctgggaatcacgggactagccttcgtttccttggcaacgcagtacacaagtgctagccctagcagctcgcgatgtgcttcagcagagcagacgctgcggataactacccttttggaacatgtcaacagaggaaactttttcctcacttccatcccccgaatttgattgggaacaagtttgtccctcttaggggatcaccccacagagggcctgggtgttatttttcagatggatatggcttggcatacgacttatctaagatcccaaccagtataaaaggatatactttgggagccagaacagctgtgaggtttaagccaatacagaaggaaatgacacctcatgcaggcaggtaccagaaagtaagtcctcagcaggaaaaacacaaacaaaattttgctccatttaatgtcttggtgcctcgatttaagaactacccaaaggacacttactatcccagccctggtgcatacaacccagagaagaagccaccgccaaaaattgcctggccaatgaaatttggatctccagactgggctcaggttccatgtctacagaaaagaaccctaaaagctgagctgtccacagacaaagactttagaaagcatcggaaccgtgtggcctacctaagcctgtattataattgagcggctgtaactaccttcacgtgctcctcttatacacagactctccaggactgaggacagagctgctcttcttcttctacgttactgtggccctcttgtctggcagcctggagcccagggagggacaggggcttatagctgctgtatgagaacataaagactagtgcacagtgctatctccatctactgacttgtggtgtacacgtgcatgtctgggtctgtgggtttctgttgggtgctgagttgggtgatttcattttagtgaaatatttgtgggcccctgctctctagttctaattcccaggagccaattttatatattctaccactagccctggtcataggaggctgttagcctatacatgtcaagggtttggatgggatttgggcttgctagatacagaaaacacttaaggcagattaaaacatgtattggagctctcccaattgtgttgctcagtgtggagtgggaaggtcttgatttggttgactttcccagattgacataaaactcaaaaaccaaaaaattgcccctttcctatgacatcatccatttagtctgtgagtcaacatatatactgaggtcctactatgtgttgagcagagcagtaagcactggggatatggcaggaatcaaaataaacttatctactaagtccttgggcctggcctgaagtcagaggaggactccccagggcagctaggggattgggtctgccctccaatctgaatgaccccctagaaccttacaagtcattctggggttataaagatcataacatttatagccccagactgacttgtaagcagctgcatttaaagtacttactcagacactcaggcctgagagatagacccctttctttccagcactagctgaaataatcaagtatatagtttgttcaggattggcactaaatgtgatttaatcttttaataaaagggtccttttgtacccacttaggcttcttcgtaattaccagaaaggtgataagcctgcatgtgtctggacaccaaagattgagaagctgccagtggctgcaagagagcctactgtaaccctcatggccaccccctgatgagtgttacctggggaaagggctagcaagaggtgaagcctcctggtcatatgatgctgggggtgcctaattccttaaaggccaaggtcttctgaaataataatggtgaaggacagaaaagtctttatgagaaatcacataggatatattaagataatgataaagatacctcagcaagaacatacctaatatatacacttcttttaatctgatgacttaatgatttctgttatcaagaagtatttatgacttgagataagtcaggattaactgttatcacctctcctgtacacctccctcctttttctcctttgtacccacatgtgcagattttttcagaggtgacaatttagcatttaatgtttttttttctgcttcaagttcttaggtccctttggaggatattgatgggggtggaggtggggatagaacatctttcacactgtttggtacagagacgctcaaagcttttcccagggaaaggaactctctaaaatagtaatctgatttgatgaaagataaaattttaatatagcttcagttaaccttcaggatactttaaatgctacattgtatataaaagtaataaagtacaaatgaacacgaa

SEQ ID NO: 5910 - DNA, 3131 bp, Homo sapiens
tgggcatatgtgtgaagcagcaacgtagaggggctgaagaggagaaattcatggagagaaagaatgcacctagagtgagctctgcagagtgctgcgtgggatatccctagagtttggtctagtgaaggcacgctaaccaggcacctaaggcatttcaagtagtgacttcccacatttggctaggaatgtgggtcctcctccgaagtgggtaccccctccgtatcttgttacccctgcgtggggagtggatgggtcggaggggcctgccccgaaacttggccccaggccctcctcgcagacgttacaggaaggagactctccaagccttggatatgccagtgttgcctgtaactgcaactgaaatccgccagtatttgcgggggcatgggatccccttccaggatggtcacagttgcctgcgggcactgagcccctttgcagagtcttcacagctcaaaggccagactggtgttaccacttccttcagcctcttcattgacaagaccacaggccactttctctgcatgaccagcctagcagaagggagctgggaagacttccaggccagcgtggaggggcgaggggatggggccagggaggggtttctgcttagcaaggcaccagaatttgaggacagcgaggaggtccggaggatctggaaccgagcaatacctctctgggagctgcctgatcaggaggaggttcagctggctgatacaatgtttggccttaccaaggttacagatgacacactcaagcgtttcagtgtgcgatatctgcgacctgctcgcagtcttgtcttcccttggttctcccctgggggctcaggattacgaggcctgaagctcctagaggctaaatgccagggggatggagtgagctacgaggaaaccactattccccgacccagcgcctaccacaatctgtttggattaccactgattagtcgtcgagatgctgaggtggtactgacgagtcgtgagcttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattg

SEQ ID NO: 5911 - DNA, 3175 bp, Homo sapiens
tgggcatatgtgtgaagcagcaacgtagaggggctgaagaggagaaattcatggagagaaagaatgcacctagagtgagctctgcagagtgctgcgtgggatatccctagagtttggtctagtgaaggcacgctaaccaggcacctaaggcatttcaagtagtgacttcccacatttggctaggaatgtgggtcctcctccgaagtgggtaccccctccgtatcttgttacccctgcgtggggagtggatgggtcggaggggcctgccccgaaacttggccccaggccctcctcgcagacgttacaggaaggagactctccaagccttggatatgccagtgttgcctgtaactgcaactgaaatccgccagtatttgcgggggcatgggatccccttccaggatggtcacagttgcctgcgggcactgagcccctttgcagagtcttcacagctcaaaggccagactggtgttaccacttccttcagcctcttcattgacaagaccacaggccactttctctgcatgaccagcctagcagaagggagctgggaagacttccaggccagcgtggaggggcgaggggatggggccagggaggggtttctgcttagcaaggcaccagaatttgaggacagcgaggaggtccggaggatctggaaccgagcaatacctctctgggagctgcctgatcaggaggaggttcagctggctgatacaatgtttggccttaccaaggttacagatgacacactcaagcgtttcagtgtgcgatatctgcgacctgctcgcagtcttgtcttcccttggttctcccctgggggctcaggattacgaggcctgaagctcctagaggctaaatgccagggggatggagtgagctacgaggaaaccactattccccgacccagcgcctaccacaatctgtttggattaccactgattagtcgtcgagatgctgaggtggtactgacgagtcgtgagcttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagtgagtggcctttagcggagctcaagctttggaaaatagagtgggcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattg

SEQ ID NO: 5912 - DNA, 4104 bp, Homo sapiens
tttactttgtctgctttgctaaagaaggccggtgaaccaggaccaccgcacacacaggcccaccaggggcaatgctcattccaagaccttaacttttaagagccctttgttccaacgttagtgtggacgatgctcttgcaggatgcctttccttttgggtcttagacaggataaggaagcctgtgtgggtaccaacaatcaaagctacatctgtgacacaggacactgctgtggacagtctcagtgctgcaactactactatgaactctggtggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcaggtttttgccaaactatttactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagagttcaacacactcatcgatgatgctctggatgggcccctggacttctgcgacagctgccatgtgcggccccctggtgatgaggaggaaggcctctgtcagtcctctgaggagcaggctcgagagcctgggcacccgcacctgccacggccgcccgcatgcctgctgctgaacaccatcaacgagcaggactctcccaactcccagagcagcagctcccccagctagagcaggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgctgttgagccagaagatgtctcgtgtgaaggctggggtggcggctgtcttggaacctctgtgagcaggaggccctaagccgcagcagtggatagaggtgcagctctctgcctctctgccctttggtctgtgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttttggtggcagttgtttgttttaaactgaccacttggaagaaacaccttggttatctgtggttttcatgccttgtccctgcctctacccccaccccttttgagtcgggtgactcatttttctgtgtagagactcggtggcccaggcaggaggtgaaagcagccatccggaaggccctggggacccttgtgcctgttgctcgccttcaggtcaccagctgagctgcgataggaaaatctgaatggaggcagcaaacagccaaaacaaacattccccacccggccctgtgcatatgaagtctttcttcccccaactcttgaacgatgatgatattcagacgaagcattgatgttatggaagaaagaaagaaacaaacaaaatatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaatg

SEQ ID NO: 5913 - DNA, 4085 bp, Homo sapiens
gaaggaagaagagggtagaggaggagagggaggaggaggagggaggtggcggcgccgtggcggaggagcaggagcaggagggggatggagaggagaaggctcctgggtggcatggcgctcctgctcctccaggcgctgcccagccccttgtcagccagggctgaacccccgcaggataaggaagcctgtgtgggtaccaacaatcaaagctacatctgtgacacaggacactgctgtggacagtctcagtgctgcaactactactatgaactctggtggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcaggtttttgccaaactatttactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagagttcaacacactcatcgatgatgctctggatgggcccctggacttctgcgacagctgccatgtgcggccccctggtgatgaggaggaaggcctctgtcagtcctctgaggagcaggctcgagagcctgggcacccgcacctgccacggccgcccgcatgcctgctgctgaacaccatcaacgagcaggactctcccaactcccagagcagcagctcccccagctagagcaggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgctgttgagccagaagatgtctcgtgtgaaggctggggtggcggctgtcttggaacctctgtgagcaggaggccctaagccgcagcagtggatagaggtgcagctctctgcctctctgccctttggtctgtgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttttggtggcagttgtttgttttaaactgaccacttggaagaaacaccttggttatctgtggttttcatgccttgtccctgcctctacccccaccccttttgagtcgggtgactcatttttctgtgtagagactcggtggcccaggcaggaggtgaaagcagccatccggaaggccctggggacccttgtgcctgttgctcgccttcaggtcaccagctgagctgcgataggaaaatctgaatggaggcagcaaacagccaaaacaaacattccccacccggccctgtgcatatgaagtctttcttcccccaactcttgaacgatgatgatattcagacgaagcattgatgttatggaagaaagaaagaaacaaacaaaatatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagccc

SEQ ID NO: 5914 - DNA, 1583 bp, Homo sapiens
acaaagcaggcagacttgcccacagaacccacagccttcccctcgatttgtcctcttgctccttcctgctaggacagcagggcttctcgtacacatgctgtagcgggcactgccttggcaggaggatttggggcttccacatatcctgttctcaagattgtagcatctcagtactctagagcccagtacctgacatcaaggatgtctggagcttccttttaaggaaagaaaagatcagcaaacttgcctgttcccgtttacacttccaccaccagttcgtgagagttcctgttctgcatcctcaacactagtattaagtgagagttcctgttctgcatcctcaacgctagtattaagtgcactggcctttagtctgttaaaaagcatacaatggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgaagcctggaagaaggagttgaaggagctagcttcccgggtggccttcctcaccaaggaggatgaactgaagaagaaagagaaggagcagaaggaggagcctctgcgggagcagggggcaaagtactcagcagagactgggaggctcatccccgcttccacccgggctgtcggccgccgcagatctcaccagggccagcagagtcagtcttccagcagacatgaaggagtccaggctttcctccttcaggatcaggagctgctggtcctggagctcctgtgtcggatcctggaaacagacttgctaagcgcaatccagttctggctgctctacgctccgcccaaggaaaaagacctcgctctgggactcctgcagacagcagtggctcagctccttccccagcccctagtctccatccctacagaaaagctcctaagccagcttccagaagtgcatgaacctcctcaagagaagcaagagccaccctgcagtcaatccccgaagaaaacgaagatatcaccttttacaaaaagcgaaaaaccagagtacattggagaagctcaagtcctccagatgcattcaagccagaacacagagaagaagacatcgaagccgagggcagagagctgaggggccctaacacttgcacctgccttgctcaagagcagccccaagggttcaggggtgtttctgtctccaccaccttcacagcagtacctgattccctaccgtgaaaactcttactaaataaaaccgtcttccctgag

SEQ ID NO: 5915 - DNA, 353 bp, Homo sapiens
caatgtgctgaactctggggatcagtgaggaagaattcagacaagttcctgctgtcacggaacttacatcccagcaaggaggaatacagacaacaaattaaaacacctggggaggagtggagacagatactagtacattggagaagctcaagtcctccagatgcattcaagccagaacacagagaagaagacatcgaagccgagggcagagagctgaggggccctaacacttgcacctgccttgctcaagagcagccccaagggttcaggggtgtttctgtctccaccaccttcacagcagtacctgattccctaccgtgaaaactcttactaaataaaaccgtcttccctga

SEQ ID NO: 5916 - DNA, 824 bp, Homo sapiens
atggctacagatgttcaattggctgattatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgaagcctggaagaaggagttgaaggagctagcttcccgggtggccttcctcaccaaggaggatgaactgaagaagaaagagaaggagcagaaggaggagcctctgcgggagcagggggcaaagtactcagcagagactgggaggctcatccccgcttccacccgggctgtcggccgccgcagatctcaccagggccagcagagtcagtcttccagcagacatgaaggagtccaggctttcctccttcaggatcaggagctgctgaaaaagacctcgctctgggactcctgcagacagcagtggctcagctccttccccagcccctagtctccatccctacagaaaagctcctaagccagcttccagaagtgcatgaacctcctcaagagaagcaagag

SEQ ID NO: 5917 - DNA, 973 bp, Homo sapiens
agtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgcctggaagaaggagttgaaggagctagcttcccgggtggccttcctcaccaaggaggatgaactgaagaagaaagaggatactaccagtcttaattggaattgcaagagcaggaggccccaggcaccaggcctctctgggacagacctgggggcagctgagctgggaattaagaaggagcagaaggaggagcctctgcgggagcagggggcaaagtactcagcagagactgggaggctcatccccgcttccacccgggctgtcggccgccgcagatctcaccagggccagcagagtcagtcttccagcagacatgaaggagtccaggctttcctccttcaggatcaggagctgctgggcggcctcacctcacctggagctcctgtgtcggatcctggaaacagacttgctaagcgcaatccagttctggctgctctacgctccgcccaaggaaaaagacctcgctctgggactcctgcagacagcagtggctcagctccttccccagcccctagtctccatccctacagaaaagctcctaagccagcttccagaagtgcatgaacctcctcaagagaagcaagag

SEQ ID NO: 5918 - DNA, 946 bp, Homo sapiens
acagccccagtagctgctgcgtcagctcttcctctcctaggagggacccccatgggaacagaacttgctggtctggtctggcctaagctccagctctggcctctggacgctgagtctgagccaagactactcctgagtgcatgggggaggatgacagcctatagctggcctctgggctgtccacagtctggcttggggagaggcccctgttgagaccatccccatccccagggatgtatataagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgcctggaagaaggagttgaaggagctagcttcccgggtggccttcctcaccaaggaggatgaactgaagaagaaagaggtgggtgcggaacacaggagctagtctgggaagaggagaaacggatccttccctgtgtaaggagatccctcccgagtcagttcagcctaccagaggtggggtggggggactgattcatacaaacgtcaggggaaaggtcacagtgagggagagagcacacctaggtggagaaatccaagcaggggttttaggacaggaggcacttgggggccttcgatatctaagtgagatgttcacaa

SEQ ID NO: 5919 - DNA, 1241 bp, Homo sapiens
ggagggtgcagcagggggcctgcctgtcagacatccttggggagcctgccctttcaagcatgaatcataccaccagagatcacccagcgtgctcttagctctgcctgcctggtgtagggtcctggagaccttcttggagctcatccagcagccatcatgcaaggtggtgctggggactgccctcttgctaggaggtggaggtctcatgctgtgggttcagagaaagaggagaagaaaggaaacctctgagtgtccatcagacaaggacaagtcaccagaatcccataaagcaaagaatgaaagctggattaaatcccactttagccgcctttccgaagagaagctggccctcgacaacaatgccagcgctagtggcaatgctacccagactgagagtgggagtgaagaggtcagctccacggttcacatagagaccttcaccacgaggcacggagaagtgggctccgctctgcaccgggaatccttcaccagcaggcagaagacatctgggccctcagtgatccaagagatccaccaggagtctggaaaagccccatccactgatgaggccacgtgggccgctgtggctgcctgcaccaaggagattgacacccaggggcggcacctggctcactccatgctgcagcgggccatagcttaccagcactcaggtcacctagagtccaaggacatcaaccaggaggagctgagggccctcgaggaggtagagatgaagctgcaaaagaatttcctcacccagcgggaaaacaccatagctggtgccaatcacacacacaccttctatggccacagtcaccacagtcaccatggccacccaagccaccagagccacagcctgcctaatcgcagacactagatctgtgacttcttggaagccacctaaccatggatggagacgcccctgcccccagcaaggctggctcacacacacgtctgttttctctcctatggggccatctatgcaggccagggtgagatgctgtgcccaaatccctactttcttaggctcctcacggggattatgggctctttaaactccatgagtggggtctgccacagaagatggcccctgttggagggagagctgggaggacacagcgcaggtgagatagaccctgaggcccctgaagacccaccaagagaagacagatgggagcaggcaagagccccacactgatgtcattgcctggaacggagccaataaagctttgtgtgccttc

SEQ ID NO: 5920 - DNA, 2956 bp, Homo sapiens
aggaggtaggctgcatccgcccctctgtctgtctgtcaacatcgccctaggaccgagctgctgggtgccccggaagaagggcaggcaggaaggggaggggcagtgaggttggctccccccaccacctcaccctggtgcccccagcccagcccaagacaccagggcatttgctgacatctgaggcccttcccaggaagacatggcctcgttcttggtgtggccactgaggacggcgctgagagggggaaagtcatgggcaggacctggtgtgggatgtggaggagacggcgcccggggaggaggagcgctgtgcccaggtggcctcacttgtcatctcaaagtggcgtcgaaccccctgacaggtggacgggaacccccggctggccctccagagaccaggaggcccctggctcaatgatgccacctgcagctgcccaaccctccgcccatggtgcccttgttccacctgccaccgctcatgaacctgtggatcacccagctctgcactggcttgcctgctgctgctgtctcagtttacctgggcagttgcccctggctatccggctgggatgggacttggacttagaagcaggcccctcctctggaaagctgtgtcctcgggccaggaggtggcagcctctaccttcctgagacagggacccttttctgtccatcagaggacagctgtatgaagacacagagagaaggcagccatctgtaagccaggaagagagccctcaccaagactggaatcagcagcaccttgatattggacttccagcctccagaactgcaagaaataagcacctgctgtttacatgcccagcctgcagtgcttccttatggcagattggagctaactgagacagctcccagcactcattcattcattcattcattcactcacctcatgtctactaaacagctctgggctggctctgggaagcagtgagtcacacacactgcccccagcaacgtgtgaaatatgtttagagacagtgggctacagcggaaagggtagatgccctgagaaccccagcggtgctggtcagaagcacaggccttgttgggctgaggctggcatggggtgaacctggggagcctcgggggcagaggtgatagatgtggggtgtttcaaggcagtgagacaaagaagggagatgggtggtgccccccaatgccaggcttcaccagcctcccaacacacgagtgttcacccgcctggatgagacacctctgtggacttgggagtgaaggcagtgaatttgggcaatgctggaggccgtgcaggtgggaggtgggacaggggcaagaggccggggcccaggcaggagctgacagcccaccagtggtgctcccctgagaagcaacctcagtgggtggcttggggtctgctgggctgtccccacactgacaccctggctgcagggcccccctgtgtccccagtgaggggtctcgggagctgtgtgtcctactcagggccatccctgcagcccatgctctctgggtgaccagttgccagcagtgtcccccctgccttgggcggaggctgaggaccccagggtgggagggaaggtgcggtgggggctcagccaatgctgcccagcctgagggtccctcacatgtgggccgcacccctgcgtcagccggagtgatctctgcttagggtggtttgaggtgagttctgatatctcaaacaccagcatcagggccagggcagacaaaataagagtgagctggtcaggggtgtcccagttgggagctcgctcacagtctttaaggaggcagggcacagcccagtgggggtggccacgaggccccgggcctgtggctgagatggcaactggcaccggcagtgattggaacagtccagcccatggagccctgtggccttggccggtggctcacggtgccacgggagctggagcaatgggtggcctcccttgcctggtgcctgagtgaaggaggactgggtgcccctgaggaaggaccttgccatactcctacaaatttacattattcttctttccccagtctcccctcagggacctgcagccatttgctggggtggctagtggaaagggggatcatcagactcagggggattactggactctaactctaacctgacacccactcctggggacacaaacacccatcggatctaatagtcagaggaggggcgtatggaggtcagtgggctcacggagttctagctcaggtccaaccctcggtgggtgcagaggtcacttccctagcctcagatgggtgagtaaacagacgtatgtggcagccagcagagcccccacatttgttccctgacctgagggtgggggctactatgctgggaaaggccaggtggaagccattggggtgaactctgcctaggaaaattgtcagtcaaaagcaacctgcagccctggagggactgcaaaggtcagtgccgccatcgaggacttggaagatgcagggtggtgacccccactgcagcctcgttccactcgtctaattggcttgtgtggaagacaggggggtcccggagaaagaaggacagtgaatcctggtaaacttaaccaggactccaattgcaactgctgttccagatatgactactgatcactggggcaaatcaaagcatccccggacacctggtctacagccattgatctggtgaaagctttaatttttaatatagattttattttttagagcagtttcatgtttacagagaaattgagcatatttgagagtcctcatatagcatctctccctacacacagtttcccttattattcatatcttgaattactgtgatacatctttgcaattgatgaaccaatattgacctagtcattgatcaggttacatgagggttcactcttcttgttgtacatgctgtgagttcgggcaaatgtgtaatggcatatctccactattacagtgtcacacagaatt

SEQ ID NO: 5921 - DNA, 1366 bp, Homo sapiens
agcccaagacaccagggcatttgctgacatctgaggcccttcccaggaagacatggcctcgttcttggtgtggccactgaggacggcgctgagagggggaaagtcatgggcaggacctggtgtgggatgtggaggagacggcgcccggggaggaggagaattgtctctctccaaccttgacctccctggagctggtgaggcgggcctggagcaccacccgcttctgggacacctcttcatcagcgctgtgcccaggtggcctcacttgtcatctcaaagtggcgtcgaaccccctgacaggtggacgggaacccccggctggccctccagagaccaggaggcccctggctcaatgatgccacctgcagctgcccaaccctccgcccatggtgcccttgttccacctgccaccgctcatgaacctgtggatcacccagctctgcactggcttgcctgctgctgctgtctcagtttacctgggcagttgcccctggctatccggctgggatgggacttggacttagaagcaggcccctcctctggaaagctgtgtcctcgggccaggaggtggcagcctctaccttcctgagacagggacccttttctgtccatcagaggacagctgtatgaagacacagagagaaggcagccatctgtaagccaggaagagagccctcaccaagactggaatcagcagcaccttgatattggacttccagcctccagaactgcaagaaataagcacctgctgtttacatgcccagcctgcagtgcttccttatggcagattggagctaactgagacagctcccagcactcattcattcattcattcattcactcacctcatgtctactaaacagctctgggctggctctgggaagcagtgagtcacacacactgcccccagcaacgtgtgaaatatgtttagagacagtgggctacagcggaaagggtagatgccctgagaaccccagcggtgctggtcagaagcacaggccttgttgggctgaggctggcatggggtgaacctggggagcctcgggggcagaggtgatagatgtggggtgtttcaaggcagtgagacaaagaagggagatgggtggtgccccccaatgccaggcttcaccagcctcccaacacacgagtgttcacccgcctggatgagacacctctgtggacttgggagtgaaggcagtgaatttgggcaatgctggaggccgtgcaggtgggaggtgggacaggggcaagaggccggggcccaggcaggagctgacagcccaccagtggtgctcccctgagaagcaacctcagtgggtggcttggggtctgctgggctgtccccacactgacaccctggctgcag

SEQ ID NO: 5922 - DNA, 2063 bp, Homo sapiens
cccggagctgcctgggttgcgctgccggccacgtccccgcgccgggcctcaggctccttcctactgtccgagggccaccaggccgccgggggcctgctgcgcccggatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccacgcaactttgtccctaacaaaatgtggaagggattagtcaagaggaatgcatctgtggaaacagttgataataaaacgtctgaggatgtaaccatggcagcagcttctcctgtcacattgaccaaagggacttcggcagcccacctcaactctatggaagtcacaacagaggacacaagcaggacagatgtgagtgaaccagcaacttcaggaggtgcagctgatggtgtgacctccattgctcccacggctgtggcctccagtacgactgcggcctccattacgactgcggcctccagtatgactgtggcctccagtgctcccacgactgcagcctccagtacaactgtggcctccattgctcccacgactgcagcctccagtatgactgcggcctccagcactcccatgacacttgcactccccgcgcccacgtccacttccacagggcggaccccgtccactaccgccactgggcatccatctctcagcacagccctcgcacaagtgccaaagagcagcgcgttgccaagaacagcaaccctggccacattggccacacgtgctcagactgtagcgaccacagcaaacacaagcagccccatgagcactcgtccaagtccttccaagcacatgcccagtgacaccgcggcaagccctgtaccccctatgcgtccccaagcacaaggtcccattagccaggtgtcagtggaccagcctgtggttaacacaacaaataaatccacacccatgccctcaaacacaaccccagagcccgcccccacccccacagtggtgaccaccaccaaggcacaagccagggagccaactgccagcccagtgccagtacctcacaccagcccaatccctgagatggaggccatgtcccccacgacacagccaagccccatgccatatacccagagggccgctgggccaggcacatcccaggcaccggagcaggtagagactgaagccacaccaggtactgattccactgggccaacacccaggagctcagggggcactaagatgccagccacggactcgtgccagcccagcacccaaggccagtacatggtggtcaccactgagcccctcacccaggccgtggtagacaaaactctccttctggtggtgctgttactcggggtgacccttttcatcacagtcttggttttgtttgccctgcaggcctatgagagctacaagaagaaggactacacccaggtggactacttaatcaacgggatgtatgcggactcagaaatgtgaggggggcgggggcctggcgggaggcctggccccttcctcgtcctttccttttgcctttgagaccaaaccaagtgcttccaaattcttttggtgcaattgaggagatatgccagatgcttaaacacatttaattgctgtcagattaattccatgatcactaaagagttgctgcttttttcatatttatttttgtaaatgattctgtgcccaggagcagctgggggttccacctcagggtggggcgggcaggaccccgtctccccaggtgtcggagcctgacctgaattaaagtactgactgctcgccacaa

SEQ ID NO: 5923 - DNA, 533 bp, Homo sapiens
tgggcggggcccgggcagggcgcgctgcccggagctgcctgggttgcgctgccggccacgtccccgcgccgggcctcaggctccttcctactgtccgagggccaccaggccgccgggggcctgctgcgcccgggaatgtggactttttttcaaactctagatgcgtctgttactagagtggagagtctaccttcgtctcacatgtgccacaaaggatggcatggcccgggagtgccccaccacgtggctttcaccccctgcaaagccagacttcgcccagcgacacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagatgtggacagctcttgtgctcatttggattttctccttgtccttatctgaaagccatgcggcatccaacgatccac

SEQ ID NO: 5924 - DNA, 5508 bp, Homo sapiens
gtcgccatcttgccccttcagaggcaccgcaaacaaacccaattcctggtgtcccctagtcttggcggaggagccttttagatgagccccgaaaggccgggcagggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataatatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaagtggtttgctattcctacacaagtaccacgtcaaccccaacctctacccctgttccaagtggcagcatagcaacggttaagtctccaagacctgccagtcctgcctccaatgtagttgtcttgccaagtggaagtactgtttatgtcaaaagtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaaggtgtatctacatcagcaatcaaaatggcatcaaccagacttccttcccccaaaagcttagtgagtgccccaactcagattcttgcacagttccctaaacaacatcaacagtctcctaagcagcagttatatcaagtgcaacagcagacacagcaacaagtggcccagccttctccagtatctcatcagcaacagcctcagcagtctcctttgccacctggtattaaacctaccatccaaatcaaacaggagtcaggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggaacgactaccaaaatcactacaatcccaatgacttccaagcccaacgtgattgttgtacaaaagactacaggaaaaggaacgaccattcaaggcctcccgggcaaaaatgttgtcacaacgttgctaaatgctggaggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaagattcccagcctgtagttcatgtaattgcttcccggcgtcaggattggtcagaacatgagattgcaatggagactagccctaccataatttatcaggatgtatccagtgaatcacaatcagctacttcaacaatcaaagctctgttagaactccaacagacaacagtaaaggaaaaattggaatctaaaccaagacaacccactattgacctgagtcaaatggcagtgcctattcagatgacccaggaaaagagacattctcctgagagtccatcaattgctgtggtagagtcagaactagtagctgaatacatcactactgaacgcactgatgaggggacagaggttgcttttccccttctagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaaaaaaaagctgcacatttacagtgacttaagacctggtcttctttctctgttggatcatggccggtgaaacagttttgtcttgcagtggaaagagacttcctgtgaatgtttctcaactggtttctactgagcaaaataccatctaaaaggagaatgtgaatagttgtattttgaaatgatgtgtcaggaaaagttttttaaaaacttgtatgtttttgcaaatccctggaagtgttgaattggttaaaattttacattttctcagttcataattagtttataaacacctagaataatactggcattaaagaatccttgttggatggtagaaatcagatccctaaccagtgggaggtactttttgggtggcttgtgcattcttatcagttgtgtgctaatttattgtattgttcctttgtgctctaagcagcacacttgccttctatttatttaagtgtaaacatttcaaagcaggccgtactccttctgacaaatttcttgtaaaccaggattgcctacgctttccactgtcgtcgtctccccactttccctcttcctttaagaaaacttactaaaaaatgtttcattgcgaagcagaggaaaagaaacgttttcagacctaaaggaaatgtttggtcatgttaagaaaacaaattattcattcatatgatgctttcttaacgttgaaattgcacattcacattggactgagactttgaaaataacttttacatacttttgtttaagcccctttgaaatgtataaaaagttcatttacagttctaaatgtaatgtttttaagccttctatctttttaggacacagtttgtttaagcaatatgttttggtcttgtgatcactgtctgtcacaagtagagtgaaaggggtaagggggtgggagggtaagagttttgacaagttgtggcaaaggaaactatacttttcatttttaaaaatgtaaatagaaaagtttttaacggttttatatagatttcactataaataagcattttaagactgacaaatgttgaactgtacatacatttatcagcataactgcccagtttttttggtgctgaagtactgtaagtagaattcatcaacggtctcctaatttttgcatctacatctggggggaaaaagctgtgatactatagttaataaattcccactagagtg

SEQ ID NO: 5925 - DNA, 5007 bp, Homo sapiens
gtcgccatcttgccccttcagaggcaccgcaaacaaacccaattcctggtgtcccctagtcttggcggaggagccttttagatgagccccgaaaggccgggcagggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataatatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaagtggtttgctattcctacacaagtaccacgtcaaccccaacctctacccctgttccaagtggcagcatagcaacggttaagtctccaagacctgccagtcctgcctccaatgtagttgtcttgccaagtggaagtactgtttatgtcaaaagtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaaggtgtatctacatcagcaatcaaaatggcatcaaccagacttccttcccccaaaagcttagtgagtgccccaactcagattcttgcacagttccctaaacaacatcaacagtctcctaagcagcagttatatcaagtgcaacagcagacacagcaacaagtggcccagccttctccagtatctcatcagcaacagcctcagcagtctcctttgccacctggtattaaacctaccatccaaatcaaacaggagtcaggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggaacgactaccaaaatcactacaatcccaatgacttccaagcccaacgtgattgttgtacaaaagactacaggaaaaggaacgaccattcaaggcctcccgggcaaaaatgttgtcacaacgttgctaaatgctggaggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaagattcccagcctgtagttcatgtaattgcttcccggcgtcaggattggtcagaacatgagattgcaatggagactagccctaccataatttatcaggatgtatccagtgaatcacaatcagctacttcaacaatcaaagctctgttagaactccaacagacaacagtaaaggaaaaattggaatctaaaccaagacaacccactattgacctgagtcaaatggcagtgcctattcagatgacccaggaaaagagacattctcctgagagtccatcaattgctgtggtagagtcagaactagtagctgaatacatcactactgaacgcactgatgaggggacagaggttgcttttccccttctagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaaaaaaaagctgcacatttacagtgacttaagacctggtcttctttctctgttggatcatggccggtgaaacagttttgtcttgcagtggaaagagacttcctgtgaatgtttctcaactggtttctactgagcaaaataccatctaaaaggagaatgtgaatagttgtattttgaaatgatgtgtcaggaaaagttttttaaaaacttgtatgtttttgcaaatccctggaagtgttgaattggttaaaattttacattttctcagttcataattagtttataaacacctagaataatactggcattaaagaatccttgttggatggtagaaatcagatccctaaccagtgggaggtactttttgggtggcttgtgcattcttatcagttgtgtgctaatttattgtattgttcctttgtgctctaagcagcacacttgccttctatttatttaagtgtaaacatttcaaagcaggccgtactccttctgacaaatttcttgtaaaccaggattgcctacgctttccactgtcgtcgtctccccactttccctcttcctttaagaaaacttactaaaaaatgtttcattgcgaagcagaggaaaagaaacgttttcagacctaaaggaaatgtttggtcatgttaagaaaacaaattattcattcatatgatgctttcttaacgttgaaattgcacattcacattggactgagactttgaaaataacttttacatacttttgtttaagcccctttgaaatgtataaaaagttcatttacagttctaaatgtaatgtttttaagccttctatctttttaggacacagtttgtttaagcaatatgttttggtcttgtgatcactgtctgtcacaagtagagtgaaaggggtaagggggtgggagggtaagagttttgacaagttgtggcaaaggaaactatacttttcatttttaaaaatgtaaatagaaaagtttttaacggttttatatagatttcactataaataagcattttaagactgacaaatgttgaactgtacatacatttatcagcataactgcccagtttttttggtgctgaagtactgtaagtagaattcatcaacggtctcctaatttttgcatctacatctggggggaaaaagctgtgatactatagttaataaattcccactagagtg

SEQ ID NO: 5926 - DNA, 4554 bp, Homo sapiens
gtcgccatcttgccccttcagaggcaccgcaaacaaacccaattcctggtgtcccctagtcttggcggaggagccttttagatgagccccgaaaggccgggcagggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataatatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaaggtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaaggtgtatctacatcagcaatcaaaatggcatcaaccagacttccttcccccaaaagcttagtgagtgccccaactcagattcttgcacagttccctaaacaacatcaacagtctcctaagcagcagttatatcaagtgcaacagcagacacagcaacaagtggcccagccttctccagtatctcatcagcaacagcctcagcagtctcctttgccacctggtattaaacctaccatccaaatcaaacaggagtcaggtgttaaaatcatcacacaacaggttcaaccaagtaaaatcttacccaaaccagtgacagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaaaaaaaagctgcacatttacagtgacttaagacctggtcttctttctctgttggatcatggccggtgaaacagttttgtcttgcagtggaaagagacttcctgtgaatgtttctcaactggtttctactgagcaaaataccatctaaaaggagaatgtgaatagttgtattttgaaatgatgtgtcaggaaaagttttttaaaaacttgtatgtttttgcaaatccctggaagtgttgaattggttaaaattttacattttctcagttcataattagtttataaacacctagaataatactggcattaaagaatccttgttggatggtagaaatcagatccctaaccagtgggaggtactttttgggtggcttgtgcattcttatcagttgtgtgctaatttattgtattgttcctttgtgctctaagcagcacacttgccttctatttatttaagtgtaaacatttcaaagcaggccgtactccttctgacaaatttcttgtaaaccaggattgcctacgctttccactgtcgtcgtctccccactttccctcttcctttaagaaaacttactaaaaaatgtttcattgcgaagcagaggaaaagaaacgttttcagacctaaaggaaatgtttggtcatgttaagaaaacaaattattcattcatatgatgctttcttaacgttgaaattgcacattcacattggactgagactttgaaaataacttttacatacttttgtttaagcccctttgaaatgtataaaaagttcatttacagttctaaatgtaatgtttttaagccttctatctttttaggacacagtttgtttaagcaatatgttttggtcttgtgatcactgtctgtcacaagtagagtgaaaggggtaagggggtgggagggtaagagttttgacaagttgtggcaaaggaaactatacttttcatttttaaaaatgtaaatagaaaagtttttaacggttttatatagatttcactataaataagcattttaagactgacaaatgttgaactgtacatacatttatcagcataactgcccagtttttttggtgctgaagtactgtaagtagaattcatcaacggtctcctaatttttgcatctacatctggggggaaaaagctgtgatactatagttaataaattcccactagagtg

SEQ ID NO: 5927 - DNA, 6848 bp, Homo sapiens
atgcctgttgtgtggccaacccttctggatctcagcagggatgaatgcaaaagaattcttcgaaaattggaattggaggcatatgctggagttatcagtgcacttcgggcacagggggatctcaccaaggaaaagaaagatcttcttggagaactatcaaaagttcttagcatctcaacagaacgccaccgtgctgaagttcggagagcagtaaacgatgaacggttaacaacaattgcacataatatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaagtggtttgctattcctacacaagtaccacgtcaaccccaacctctacccctgttccaagtggcagcatagcaacggttaagtctccaagacctgccagtcctgcctccaatgtagttgtcttgccaagtggaagtactgtttatgtcaaaagtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaaggtgtatctacatcagcaatcaaaatggcatcaaccagacttccttcccccaaaagcttagtgagtgccccaactcagattcttgcacagttccctaaacaacatcaacagtctcctaagcagcagttatatcaagtgcaacagcagacacagcaacaagtggcccagccttctccagtatctcatcagcaacagcctcagcagtctcctttgccacctggtattaaacctaccatccaaatcaaacaggagtcaggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggaacgactaccaaaatcactacaatcccaatgacttccaagcccaacgtgattgttgtacaaaagactacaggaaaaggaacgaccattcaaggcctcccgggcaaaaatgttgtcacaacgttgctaaatgctggaggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaagattcccagcctgtagttcatgtaattgcttcccggcgtcaggattggtcagaacatgagattgcaatggagactagccctaccataatttatcaggatgtatccagtgaatcacaatcagctacttcaacaatcaaagctctgttagaactccaacagacaacagtaaaggaaaaattggaatctaaaccaagacaacccactattgacctgagtcaaatggcagtgcctattcagatgacccaggaaaagagacattctcctgagagtccatcaattgctgtggtagagtcagaactagtagctgaatacatcactactgaacgcactgatgaggggacagaggttgcttttccccttctagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattaccctccacccacatggtggtggcagggatggcgaattccactccccagcaacagaaatgtagagagtcctgttcgagtccatccactgttggctcttccctaacgacaaggaaaattgatccaccagcagtgcctgcgacaggccagttcatgcgtattcagaatgtaggccaaaagaaagctgaagagagtccagcagaaattatcatccaggctattcctcagtatgctattccttgtcactccagctccaatgtggtggtggagcccagtgggcttcttgagctaaacaacttcactagtcaacagctggatgatgaggagacagcaatggagcaggacatagacagtagcacggaggatggaactgaacccagcccttctcagagctctgctgaacggtcctagtgtttggacacaatagtgcactttaaaacctgcttggttaccaagtgtccagggaaacccttgtattttgatgactaaaaagagcactttgcccgtacttaggctgtggaccctaaaacagcagtgtttcaacaagatgttgctgcaggagcagctttttaaaacaagataaaactcacaggggaatgtacttttttaaaaaaaaatgaaaaagaaaaaaaaagctgcacatttacagtgacttaagacctggtcttctttctctgttggatcatggccggtgaaacagttttgtcttgcagtggaaagagacttcctgtgaatgtttctcaactggtttctactgagcaaaataccatctaaaaggagaatgtgaatagttgtattttgaaatgatgtgtcaggaaaagttttttaaaaacttgtatgtttttgcaaatccctggaagtgttgaattggttaaaattttacattttctcagttcataattagtttataaacacctagaataatactggcattaaagaatccttgttggatggtagaaatcagatccctaaccagtgggaggtactttttgggtggcttgtgcattcttatcagttgtgtgctaatttattgtattgttcctttgtgctctaagcagcacacttgccttctatttatttaagtgtaaacatttcaaagcaggccgtactccttctgacaaatttcttgtaaaccaggattgcctacgctttccactgtcgtcgtctccccactttccctcttcctttaagaaaacttactaaaaaatgtttcattgcgaagcagaggaaaagaaacgttttcagacctaaaggaaatgtttggtcatgttaagaaaacaaattattcattcatatgatgctttcttaacgttgaaattgcacattcacattggactgagactttgaaaataacttttacatacttttgtttaagcccctttgaaatgtataaaaagttcatttacagttctaaatgtaatgtttttaagccttctatctttttaggacacagtttgtttaagcaatatgttttggtcttgtgatcactgtctgtcacaagtagagtgaaaggggtaagggggtgggagggtaagagttttgacaagttgtggcaaaggaaactatacttttcatttttaaaaatgtaaatagaaaagtttttaacggttttatatagatttcactataaataagcattttaagactgacaaatgttgaactgtacatacatttatcagcataactgcccagtttttttggtgctgaagtactgtaagtagaattcatcaacggtctcctaatttttgcatctacatctggggggaaaaagctgtgatactatagttaataaattcccactagagtgacactgaagatttaaacacaagcattcataagatgcgctgatctctggtggttgtcactagttctgctaggtgataatgatttacccatagatggagctgttggatattattttattgtacaaattcatgtttaaaaaactttgtgactgtttctagttaagtaattttttaacctttcttgggtcatagacttctttggtaaactatgaactctcaccaaaaagatacacatgcaacatgttaaatacatgttagactttgcatacaattttaggggctcatgggcctctaagcctatccatgtattccaggttaagccctctgttatgatcaatccattacttacagattaagtttttataaaataaagtatcttttaaatattcatggatcaagtaacaagagcaaacttgaataaagttatgttctacatattttggcagcatagcatacctgtgtcccttgagaatttagccttcatatgtttctgcaattggaatggcaaataaaagtgctatcatctacatttttttaaagaattacaaatattaagaaattatcaagtgaaatttaaaatttttcttttaaaggtgttaattccaaatagagcatgcattcatttatttattcaacaaatattaattgagcatcttctgtatgacaagtagtattctgtgcactggggataccatagtgaacaaacaggaaatcctatccttatgaagtttataaacagggcttcctgctcatgaaatggatacaaggaatgaagacaggagaaaataagaacaatacttaggtttttttataaagtggatagatgatgatgccatatatggattttcagacatccctttactgaaagtcttagcattatatctattagtattccacatttaagtacataatttaaaagtaatttaaagtcatctctttgaaggatattaacaaattacaatgcaaatgctacagaatttttagaatcctaacaactattaggcagtgataagaaaaatccatttggcttaaagtaaactttaataagtgcctagtattgcagatgcagtttatggtgaacttagaggattaaaaaccaaagggggcttcattgagatattcacatgccataaactctcccatttaaagtataccgtttaatggttttagtatatccacagagttgggcaagccattaccacaatcaatttgagaacattttcattaatcacaaaagaaatcctgaaatgaaaccaccaccaccatcgctccagccctgggtggccactcctctactttctgcctcttatggatgtgccataagaaatgtggacatttcatataaatgagattatataatatgtggtcttttgtgacttctttcacttagcgtattttcaaggttcatccgtgttgtagaatgtgtcagtactacatttctttttatggccattccattgtgtgaaatatatcacattttgttta

SEQ ID NO: 5928 - DNA, 1541 bp, Homo sapiens
aatgacaggcgtaaaagaaaaccatattcaggacattccctttcttgagcaaaactgcaatttgcaaaatcatcggtgacaggtaatggtgactggtgattcattcctggtgatgtcttgggccaaattccagaatccaatgtatattcagaaggggcagggagaagatctgcatgtatgacttcacccagaagccctggcatataaacaagaggtgagttgtcagtttcacccaattccaggcctagcactttccaaacagactgagaccatggcagtcttccatgacatgctgctgcagccactggggatgtttctgtgcctcagtctgcagctttcttctgccacctttataaggtacagtagcacctgcttcacctttgatgaatactacaccataaccctagacatcaaggccagttcacatatctacgaaagcaatgcagtctattctgtatttgttcccgtgaatgacagcgtctatgctgtggtcatgaaaaccttggacgagaacagtgactcagcgggcctctggcaaagagcggataaaaattgctacagcaactccacgtattacgtgaaagatcaatacatgacggtcttagaggcacagtggcaagctcctgaacctgagaacataactgaagtggagatacaagctttcactgtccagatcagagcgctgcctatactttctactctgaagctaagagaaaaactgtcaaccttagccttagctgccaagattccccagagctcagccttcaagcctttcttcatgattacacccaagagtatcagactcgaaggcttggccaaccaagtcttcagcagccccatcacagaggccatttatatcctgcttgcttttctcaccagcacacttctcttctaaagggaagccagggaaacaattgtttctgcctccactgcatcctcctacattcagttccaagctagtgctgggaaccgaatgtgtgtaaatgaaggctttacattctcaaatgtgcaactttgctgccacggcttcagaccaaaacaaagatctggaggcactcattggcaggcttgggtcacatagatgttcatctggatctttcaggacacatattacactttttgaaaatatttagaactggccggaacttagtcacctaggttctccctattggttgaacaggttggcagccaattccacagccaatctcaacttttgttcactgccaaatgattcccctgcaacctctgagtttctgtgggaagaatccttccttactttcaagatgatctcagatttctaaccaaacccattcaggttacaaggaacttctgtgactcatgtgactcaagaaagaaaggagaaaggagaaatagctctgaggctgctggcagcttcccatttgtccacaccagtagattttgaagggcaagagaacaggaacgaaccatgtctgagaagccaatatagaaaaaaactatgttataaaaacatttttgtcacaacaaataaattatactttaaacaagaataatgaatgtgt

SEQ ID NO: 5929 - DNA, 4492 bp, Homo sapiens
tcattccatcatctctgagccagcagagcaatcccccaaagtgctgttagttccccaaacagctccagccgacccctctttaggtcagaacatagctaatcccttaatcccattttctgatgaaatggaccacactgcatcccaaaatgcccaggatctcataggcatccctcatctaggtgtttctggatcctcaacaaaatggcattccgagctgtccccaacagagggtccccattcagcaggttcatccacacctgggtttttgagccccatggcagaactgtcccatccgtctccccctcccccagcacttggaagtcttcttcagcttccagatggaagcccctcatggtcaatgttggaagtggcttcaggtcctgcatccacccagcagatcaaagctggggtgcctggaagagtgcacaatggggtgtctttgccaacttttaagaatacagaaacagcgacccatgaggctgagcctccacttttccagactgcagaatcaggggccatagaaatgaccagcagaaagctagcctctgccactgcaaatgactctgctaacccgctgcatttgtcagcagctccagagaattccagagggcccgccctttcggcagaacacacctcttctttggtgccttctctgcatatcaccacactgggtcaagagcaagccatcctttctggggcggttcccgcatcaccatcaactgggacagccgactttccctccatacttactttcctccagcccacagagaatcatgcctccccatctcctgtgccagaaatgcccactcttccagcagagggcagtgatgggtcccctcctgcaactagagacttgctcctctcaagcaaagttcctaatcttctttccacatcttggacatttccccggtggaaaaaggacagtgtgacagccattttagggaagaatgaagaggcaaatgtgacgattcctctccaggcctttccaaggaaagaggttttgagtcttcacactgtaaatggatttgtctctgatttcagcaccggtagtgtctcatctcccatcattacagcaccaaggacgaatccccttccttcaggaccacctctaccttccatactctccatacaagccacccagactgttttcccatctcttggcttttccagcaccaagccagaggcttatgcagctgctgtggaccattctgggttgccagcttcagcttccaaacaggtgagagcatcgccctcctccatggatgtatatgattccttaacaataggagacatgaaaaagccagcaaccacagatgttttctggagttctctttcagcagaaactggatctctttccacagaatcaataatatctggcttgcagcagcaaacaaattatgatttaaatggacacacaattagcaccacaagttgggaaactcatttagctccaacagctcctcccaatggtttaacttcagctgccgatgccataaaatctcaggatttcaaagatactgctgggcattcagtgactgcagaagggtttagtattcaggatctagtcctcggtacaagcattgagcagcctgtgcaacagtcagacatgaccatggttggaagccatatagacctctggcccacaagcaataacaaccattccagagacttccaaacagctgaagttgcatattactcacccacaactcgacattccgtgtctcatcctcagctacagttgcccaaccagccagcacatcctcttttgctaacctcaccaggaccaacttctacaggtagcttgcaggaaatgctttcagatggaacagatacaggttctgaaatttccagtgacatcaattcatcacctgagagaaatgcttccacaccattccagaacatcttgggatatcactctgctgctgaatcttctatatcgaccagtgtctttcccaggacctcctccagagtgctgcgggcttctcagcaccccaagaaatggacaggtgcagccactaatgcagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccatgcaaggaaacatggacactgcctctggcctgttgtctacaacttacctccccaggaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacagttctctttctcacccaaaggagagtgcagatcagtgaatccttgaagttcagtatcgccaaagggctcacacaggcattgcggaaggctttccaccagaacgatgtctcagctcacgtggacattctggaatattctcataatgtcacagttggttattatgctaccaaagggaagttggtgtatttgcctgctgtggtgatcgaaatgctgggtgtgtatggagtcagcaacgtcactgcagacctgaagcaacacaccccacacttacagtctgtggcagtacttgcctccccatggaatccccagcctgcaggctacttccagctaaaaacagtgctgcagtttgtgagccaagcggacaacatacagtcctgcaagtttgctcagacaatggaacagaggctgcagaaggcattccaggatgccgagaggaaagtcctgaataccaaaagcaacttgacaattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccactggaatatcccaaccttgacatatcagaaacaaccagagactattgggtaattacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcagatggtgaagatgcagcgtgtcccaggcccgaaggacccagcggagctgacttactataccctgtacaacgggaagcctttgttggggaccgcagctgccaagatcctgagcaccattgattcccaaaggatggccttgacccttcatcacgttgtccttctgcaagctgaccccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaagcaggtcgcccagtgagaatggctctgtcatcagcaacgaatcagggaagcccagctcagggagacgctcaccccagaatgtaatggcacagcagaaagtgacaaaggaggaggcaaggaagagaaatggtgagaagccttccctccaagaaccacccccagctgctcccacgcgtgcccgcacacacatgcgtgcacacgtgtgcacaaactcacacacagccactgggctctgaccctcagtcgttctttctattctgccccacaagggccaggagtctgtatgtaccccttgggttctcaccttaccccttgtctgaattgtcctgtctcacttcctccgcccctgttcttatgaaatggtgtagttccttaggaaaaaccttttgcggaatgaactgatgtttgcttagaggtttttctaattctctagttagaaatcctctaaaatttctaatttctaatcacatgaattgacgcaatttcttgcaccagttccactaaggcagcagatctctgaaataactgctcatcttggagattcctctcattttcctgccctgactcccctgataagtttcatgggttcagtctgtgccactgagtccagatattgcaactccacttctcccaggaaaaaactaacccaaaacaataaaggaacagatctgtcatc

SEQ ID NO: 5930 - DNA, 11678 bp, Homo sapiens
gacattcccccactcctccctctacctccatcctcttcattggctcctgactcacctcattccatcatctctgagccagcagagcaatcccccaaagtgctgttagttccccaaacagctccagccgacccctctttaggtcagaacatagctaatcccttaatcccattttctgatgaaatggaccacactgcatcccaaaatgcccaggatctcataggcatccctcatctaggtgtttctggatcctcaacaaaatggcattccgagctgtccccaacagagggtccccattcagcaggttcatccacacctgggtttttgagccccatggcagaactgtcccatccgtctccccctcccccagcacttggaagtcttcttcagcttccagatggaagcccctcatggtcaatgttggaagtggcttcaggtcctgcatccacccagcagatcaaagctggggtgcctggaagagtgcacaatggggtgtctttgccaacttttaagaatacagaaacagcgacccatgaggctgagcctccacttttccagactgcagaatcaggggccatagaaatgaccagcagaaagctagcctctgccactgcaaatgactctgctaacccgctgcatttgtcagcagctccagagaattccagagggcccgccctttcggcagaacacacctcttctttggtgccttctctgcatatcaccacactgggtcaagagcaagccatcctttctggggcggttcccgcatcaccatcaactgggacagccgactttccctccatacttactttcctccagcccacagagaatcatgcctccccatctcctgtgccagaaatgcccactcttccagcagagggcagtgatgggtcccctcctgcaactagagacttgctcctctcaagcaaagttcctaatcttctttccacatcttggacatttccccggtggaaaaaggacagtgtgacagccattttagggaagaatgaagaggcaaatgtgacgattcctctccaggcctttccaaggaaagaggttttgagtcttcacactgtaaatggatttgtctctgatttcagcaccggtagtgtctcatctcccatcattacagcaccaaggacgaatccccttccttcaggaccacctctaccttccatactctccatacaagccacccagactgttttcccatctcttggcttttccagcaccaagccagaggcttatgcagctgctgtggaccattctgggttgccagcttcagcttccaaacaggtgagagcatcgccctcctccatggatgtatatgattccttaacaataggagacatgaaaaagccagcaaccacagatgttttctggagttctctttcagcagaaactggatctctttccacagaatcaataatatctggcttgcagcagcaaacaaattatgatttaaatggacacacaattagcaccacaagttgggaaactcatttagctccaacagctcctcccaatggtttaacttcagctgccgatgccataaaatctcaggatttcaaagatactgctgggcattcagtgactgcagaagggtttagtattcaggatctagtcctcggtacaagcattgagcagcctgtgcaacagtcagacatgaccatggttggaagccatatagacctctggcccacaagcaataacaaccattccagagacttccaaacagctgaagttgcatattactcacccacaactcgacattccgtgtctcatcctcagctacagttgcccaaccagccagcacatcctcttttgctaacctcaccaggaccaacttctacaggtagcttgcaggaaatgctttcagatggaacagatacaggttctgaaatttccagtgacatcaattcatcacctgagagaaatgcttccacaccattccagaacatcttgggatatcactctgctgctgaatcttctatatcgaccagtgtctttcccaggacctcctccagagtgctgcgggcttctcagcaccccaagaaatggacagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccatgcaaggaaacatggacactgcctctggcctgttgtctacaacttacctccccaggaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacagttctctttctcacccaaaggagagtgcagatcagtgaatccttgaagttcagtatcgccaaagggctcacacaggcattgcggaaggctttccaccagaacgatgtctcagctcacgtggacattctggaatattctcataatgtcacagttggttattatgctaccaaagggaagttggtgtatttgcctgctgtggtgatcgaaatgctgggtgtgtatggagtcagcaacgtcactgcagacctgaagcaacacaccccacacttacagtctgtggcagtacttgcctccccatggaatccccagcctgcaggctacttccagctaaaaacagtgctgcagtttgtgagccaagcggacaacatacagtcctgcaagtttgctcagacaatggaacagaggctgcagaaggcattccaggatgccgagaggaaagtcctgaataccaaaagcaacttgacaattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccactggaatatcccaaccttgacatatcagaaacaaccagagactattgggtaattacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcagatggtgaagatgcagcgtgtcccaggcccgaaggacccagcggagctgacttactataccctgtacaacgggaagcctttgttggggaccgcagctgccaagatcctgagcaccattgattcccaaaggatggccttgacccttcatcacgttgtccttctgcaagctgaccccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaagcctgtgcaaggctttgattatgccaagcaacacctgggccagcaaggggcagatgaggaggtcatccctgtgactcaggagacagtggttctcccactgcccattagagatgctcctcaggaaagagacgtcgctcaggatggaagcaccatcaagaccgccaaatccactgaaaccaggaagagcaggtcgcccagtgagaatggctctgtcatcagcaacgaatcagggaagcccagctcagggagacgctcaccccagaatgtaatggcacagcagaaagtgacaaaggaggaggcaaggaagagaaatgtgccagcgagtgacgaagaggagggagcggttctatttgacaactccagcaaggtggccgctgaaccctttgacacatcttctgggtctgtgcagctcattgccataaaacccacagccctccccatggtgccccccacctcggacaggagccaggagtcatcggcagtcctcaacggcgaggtgaacaaagccctgaagcagaagtcagacatcgagcactatcggaacaagctgcgcctcaaagccaagaggaagggatattacgacttccctgcagtggagacgagcaagggtctgaccgaaagaaagaagatgtatgaaaaagccccgaaggaaatggagcatgttttggatccagattcagaactctgtgctccattcaccgagtctaaaaacaggcaacagatgaagaactctgtctacagaagccggcagtctctgaacagcccgagtccaggggaaaccgagatggaccttctggtgactcgggagcgaccccggcgtggaatccgcaacagcggatacgatactgagcctgaaatcatagaggaaaccaacattgacagagttcctgagccccggggctattccaggtctcgacaggtgaaaggccactcggagacctccacactgagctcccagccatccatcgacgaggtcaggcagcagatgcacatgctgctggaggaggccttcagcctggcatccgcgggccacgcaggccagagccggcaccaagaggcctacggctcagcccagcacctgccctattcggaggtggtgaccagcgctccggggaccatgacgcggcccagggccggggtgcagtgggtgccgacctaccgcccagaaatgtatcagtacagtctgccccggccggcttacaggttttcccagcttcctgagatggtcatgggctcaccgcctccacccgtacctccccggactggtcctgtggctgtcgcttctctcaggcgatccacctcagacatcggcagcaagaccagaatggccgagtctacagggcccgagccggcccagctgcacgacagcgcctccttcacgcagatgtccagaggccctgtgtccgtgacgcagttggatcagtcggctttaaattactcaggtaatacggtgccagcagtgttcgccatcccagctgccaacagacctggcttcaccggctacttcatcccaacgcctccctcatcctataggaaccaggcctggatgtcctatgcaggagagaatgagctcccgagccagtgggcagattcggtgcccctcccagggtacatcgaggcctacccccgatcacggtacccccagagctctccctccaggcttcctcgtcagtacagccagccagccaacctgcaccccagcctggagcaggccccggcgccctccacagcggcctcgcagcagagcctggcagaaaacgacccgtctgacgctcccctgaccaacatctccactgcggcccttgtgaaggccatccgggaggaggtggccaagctggccaaaaaacagacagacatgtttgagttccaggtctaacgccttagccccgtgggactctggacttccaaactctgaggactcagcctttgggtttcccatgcctacgtgttaggacttgagacatagcaatgggtgagtctttctcaccctccatttctgaaaaggtgaactatggggcttctgggaacaggaaactcttgaacgactagattcttggctcatccaactgattgtgggtcaagtccctggcttggggccttatgtttgatactctctcatgtcaaatgtttgaactttgggcatgtgccctatggaagcttagtcacaagaggcactagctaatctacagattcctatccaatgccacattttaataaatcaccggaagcgggagaatgtagctcttatcttcggtgacctctgcatgttaactctgtttctgtgttaaaggcaatgcaggagtgtggattaagcaccagactgtattctcattcaaccatgaccgtgcgcattaaaatcagtttgtaagggagacactgactccagccaagaaacctgagccccttttttttaggttcatattcaaagtcaaatgaactggatgaaagtcagtaccaatggctgtgcctataaatagacctgattctttgtttccctcgtcaattaaacaaaggccaagaaagagagaagatgagagggaatggtggatttgcgttgacagattttttaaaaggtgttgccattttggaaataaaagtcccctacaagttaggatctaactgaaagagaatcggtgctaagagcttttaggatcctacaaaagaaacacagttatttgtgaaggtttttctttgccttgttttgaaggtggcctgagaatggagcttctctttttcttgggataatagatacatcaacttttacaagaaaatctctgtctcttcaacaatgatgtccagtgtgtgctgctgagtggtacaaaaggaaatagtacttgattcctgttagaaacaggagtggtagaaccacagtcttcccaggccgcagcctctgtttatagaagcttctgaatgtagaaaagctgttgaatttcatttaaatgtaaataaccttttaaaaagcgtatggagttagccagttccccctagttaatggacataggaagacatttgctgaaatggtagggtggccactttgtgaccatgatgttgcaagttgccctccctggcatggtgagttggcttccagagctgtgggtagaggacatcgcctcacggcactgaggcaccagccgctgcctacccatcaatgcaagcaaaacagctactgactttgtgtagcagggagattggggactctggttccctcgccaagtgtggcagcctgtgcagtgttgggggcttacttggtatctgttggagaatgaggtcctgtcctgctttcacccatgacccatctagcttcagctgtatccattttcttctgagcccatcttccattgtcctcaacgagtttctttggtctttactgaaagaagatagtagaaatttaaaagttgagagaagactagaaatggaactgattagaaggggaggttcaaactgtcaatgcacagacttttcaaagaagttgtttatattttccaatggcaaactgccctttctggaatgttcagagatgatgtgtcatggaaccttcaaacaagtctcttgttcggatgataataggtagtgtccttttagtatgctggttgatctttcatagtgttagtgttttgttacttaaaaaggaaatcagctataaataaaatgtatttttgtaattcccgtgtgtatatatggtatatttctatcaatggccagttgttgtagtccaaaacctaaatcagtttgcaaaacactgtggacagtgcgagattttattgacaggttaacacaatgcctacgtctatccacataggcattcaatgcacttgaatgaacaaagagccaaagaaactcagcctgttcatgcaaatggtatgagtctgataaaatcagctacattgtcctgctttatcaataataatatttcattagtgcaatgatatcaaccagtactttgtctacttggtaaatgcctggaaatactgtatgtgaaaatgatgtttcaagatcttactgtaattgaagtatacgtaaatgtttcagaagacagtgtctgaaatttggctgtttcaatgacttacagagactgagtctacagtttgcagagctatggctccagagtgctaagagggtggagtcacaaatcactgtggtctttacagagccccaggaaatactgagtgagtcaactgagacgactaaaaagatagcatgctaaatcagatactgtcttaaactagacaccatgggttcaagaatagtattaatagatgagaggaaaaccttaagttggaaagaaatcagtctgttcatgttatcccactcatggggagacagagccactctggtcagattttctgtgagtgagatgtggtcccttccctgaagaatctcctaacctcatagaggtgagagagatgactggacagctgactctaagagatggtcaaaagtgcctcaaggaattgaaataaggttcccagagagccctgaggaggcagcaatgaacaaacaccctgttcatcagaaccctctagatagtcacagaagccacaaaaggaccttggttgaccttggaggaggaagcagaagtaccacgaagtggagtgactggcccagtgattcagtcccaacctcctggttcacgaacctgcttgctttccatctcgccatgtggcctgcaggcttgtcagtaacacatttctttagctgtgcctagaggtttaaaaaaaagataagggtcatatgaagaactccataatgttcttgccaagaaaaaagatgattgagtatataacgaacttcagatacagtgtatagaggatgatgcatttgtggcataataaatagttttcagtgctggttttgatatgagttttctgcattcatgaaaaagaaatgcattttggctttttccagaaagagtaccatcaaggaaacggagacctcaactgctgttctagactgtgggggtgcattcctgtctcagcaccaaggatcccaacaggcaggcagggaggcccttgactttgtgtcactgtgaggcagcagagtccatgctctgcatcaggggaggtgcagtaaaggtccattgtgtggcttgagacctatgatctgaggcttgtgcataataagatggcagctgttacctacagagcaaggagtttcctctttcagggtagattatgtaagaatcaattccctggtcccaggagaagttttattgtgagtttgttaatttaagaactcactcagcagaaggacatgtaatgtctgagtaatcttgatggaagaaaggaaatagatctgtgattaaaacacacacacacacacacacacacacacacacacaccctacttcggagagagaatgtagaatggaggaggtgaggaatttaactaatagagatgctttttctaacaggcagaaattagagaaatggatcaaaagatttaaacattgattacatataaacgagtttcctttttttctacatagcacacaggtgctcaacatttaatgaataatataacagatactgtcttaaaagtttaaaaacaggatttgtacttaatcctaaattcctcttatcacacaccagaaaataatttggattttatttacaaactacatccaaatactcttaaggaaagagtgtcatttagcttggagtagggactgactggggtctaagtgttggaaattaaattctgccattcagtccaacctcaaaggtgttccaggcaaggagttttgcaaggactagaaaccctttcacacttgaagtgcaggtgttggctgaaagaatagagggacatttcacaaacacagaacacggctcccctacaggaaagggatggagacagctacctttgctcttgctctcacattctctgtcctcatggactttcttctctgtttccctctgcctatctatctgcctggttctcttgcttctcctggccaaccagctttctcattagtgcatatgtagctgaaaaatccacccctcaagaacccactccacacaacctttccttttcagtacccaccacgctctgactagcatctctgtgatgcctaaggcaaatttttgaggatctgattggtttagttcatctgcctatgggtgagccaccctggggtcaggtgcctgtccaatcacctgttaccaaggaggcagggccgtgtcatttaagcatggccccatggactgaccctttcagcagggacttttattgggggctggtacccagaagaaggagcatgagtgggcaagaccttcaaaaagaacctactacacactggaactgactagtactcctgggatgccatgccacgcagcagccagcactcggagagcagtcccctggatactaccacacagagaaaaggggcatcttcacttgcacatcaggtgagggtgcacacacttgaaactctgctagactggccagagctgccccagccacttctcaccccaccaccagttattgatacagccgctgggtctaggaagcgatttctgaacaaggcccagttagcacaatgtcttgctcagcagacaataaatacttgtaaattgaattgcatgatcttagctcaggtgctactaatgtggctcacggccacacacttgcatggataagaaaaccaatgagcccctcaacagagtcttttgaaacaaaattggtttcaagtgaaacttacattattttttggctgtgaccttctgaatataataacttagtgtcctgagaattgaaaggcctcttgatttcttaggtgaactgttacagaatcctagcctgtggtaaatgctaaaatgtaaggtgtttctgagaaggaatatttaggaaatataattgtgccacacacacattactttagaagatatgcagttgctctgattctgcaggtttaaaaaaaatgggaagtttgtgatatggcagaatctgtctccattggtcaaaccatacttcagtgagagccattataagtgaaatctaaaaattgatcgttttcattctctgactttggtcagacttttgcaaattatggagagaggccatcaacatattttacataaattactgtggccccatcttatttctcctcatttcttccttatgtttaaacacgcccccatctcacacacaaactgagaaaagatttgtatcaaacagaatcagaggcatatgaatggactggaaattgtgaaaaaggtataaatatcctagaccttgatcaactcactttaaactggtctctgattcctcatctgtcaaatgagtataagaccctctgtacttcccatggtgattttgaggagcacatgcataatgtatctgaaaatggcttgacaagcacttgaagccattcttactaaattattagttttgtaattcggttttatccaggaaaatattttagctcctcctatctgctgaattaatttatacagtcacatgttccatgacaccatgttttgccaaggaaaaataaagaaattcctaaatttgaaattgcccacaagatctagcctcatctggagttgctgttattgtccttgttgtctatgatttggaggatatgtaagtacttgtacatgtgctttaactctgggtgaaaaaccccaaccggtgagtctttaaaaccatattagacacattgggcaaagtactgagcagaagctttgaatgtagctgttgttattttaatgcttcgctttctaatgaactttgtacgtccttagcctctgccgggaacagagtgttcatatgctgttagaattttttattgtaaaataaaatgacaaaggctttcataccccaaaa

SEQ ID NO: 5931 - DNA, 11640 bp, Homo sapiens
tcattccatcatctctgagccagcagagcaatcccccaaagtgctgttagttccccaaacagctccagccgacccctctttaggtcagaacatagctaatcccttaatcccattttctgatgaaatggaccacactgcatcccaaaatgcccaggatctcataggcatccctcatctaggtgtttctggatcctcaacaaaatggcattccgagctgtccccaacagagggtccccattcagcaggttcatccacacctgggtttttgagccccatggcagaactgtcccatccgtctccccctcccccagcacttggaagtcttcttcagcttccagatggaagcccctcatggtcaatgttggaagtggcttcaggtcctgcatccacccagcagatcaaagctggggtgcctggaagagtgcacaatggggtgtctttgccaacttttaagaatacagaaacagcgacccatgaggctgagcctccacttttccagactgcagaatcaggggccatagaaatgaccagcagaaagctagcctctgccactgcaaatgactctgctaacccgctgcatttgtcagcagctccagagaattccagagggcccgccctttcggcagaacacacctcttctttggtgccttctctgcatatcaccacactgggtcaagagcaagccatcctttctggggcggttcccgcatcaccatcaactgggacagccgactttccctccatacttactttcctccagcccacagagaatcatgcctccccatctcctgtgccagaaatgcccactcttccagcagagggcagtgatgggtcccctcctgcaactagagacttgctcctctcaagcaaagttcctaatcttctttccacatcttggacatttccccggtggaaaaaggacagtgtgacagccattttagggaagaatgaagaggcaaatgtgacgattcctctccaggcctttccaaggaaagaggttttgagtcttcacactgtaaatggatttgtctctgatttcagcaccggtagtgtctcatctcccatcattacagcaccaaggacgaatccccttccttcaggaccacctctaccttccatactctccatacaagccacccagactgttttcccatctcttggcttttccagcaccaagccagaggcttatgcagctgctgtggaccattctgggttgccagcttcagcttccaaacaggtgagagcatcgccctcctccatggatgtatatgattccttaacaataggagacatgaaaaagccagcaaccacagatgttttctggagttctctttcagcagaaactggatctctttccacagaatcaataatatctggcttgcagcagcaaacaaattatgatttaaatggacacacaattagcaccacaagttgggaaactcatttagctccaacagctcctcccaatggtttaacttcagctgccgatgccataaaatctcaggatttcaaagatactgctgggcattcagtgactgcagaagggtttagtattcaggatctagtcctcggtacaagcattgagcagcctgtgcaacagtcagacatgaccatggttggaagccatatagacctctggcccacaagcaataacaaccattccagagacttccaaacagctgaagttgcatattactcacccacaactcgacattccgtgtctcatcctcagctacagttgcccaaccagccagcacatcctcttttgctaacctcaccaggaccaacttctacaggtagcttgcaggaaatgctttcagatggaacagatacaggttctgaaatttccagtgacatcaattcatcacctgagagaaatgcttccacaccattccagaacatcttgggatatcactctgctgctgaatcttctatatcgaccagtgtctttcccaggacctcctccagagtgctgcgggcttctcagcaccccaagaaatggacaggtgcagccactaatgcagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccatgcaaggaaacatggacactgcctctggcctgttgtctacaacttacctccccaggaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacagttctctttctcacccaaaggagagtgcagatcagtgaatccttgaagttcagtatcgccaaagggctcacacaggcattgcggaaggctttccaccagaacgatgtctcagctcacgtggacattctggaatattctcataatgtcacagttggttattatgctaccaaagggaagttggtgtatttgcctgctgtggtgatcgaaatgctgggtgtgtatggagtcagcaacgtcactgcagacctgaagcaacacaccccacacttacagtctgtggcagtacttgcctccccatggaatccccagcctgcaggctacttccagctaaaaacagtgctgcagtttgtgagccaagcggacaacatacagtcctgcaagtttgctcagacaatggaacagaggctgcagaaggcattccaggatgccgagaggaaagtcctgaataccaaaagcaacttgacaattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccactggaatatcccaaccttgacatatcagaaacaaccagagactattgggtaattacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcagatggtgaagatgcagcgtgtcccaggcccgaaggacccagcggagctgacttactataccctgtacaacgggaagcctttgttggggaccgcagctgccaagatcctgagcaccattgattcccaaaggatggccttgacccttcatcacgttgtccttctgcaagctgaccccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaagcctgtgcaaggctttgattatgccaagcaacacctgggccagcaaggggcagatgaggaggtcatccctgtgactcaggagacagtggttctcccactgcccattagagatgctcctcaggaaagagacgtcgctcaggatggaagcaccatcaagaccgccaaatccactgaaaccaggaagagcaggtcgcccagtgagaatggctctgtcatcagcaacgaatcagggaagcccagctcagggagacgctcaccccagaatgtaatggcacagcagaaagtgacaaaggaggaggcaaggaagagaaatgtgccagcgagtgacgaagaggagggagcggttctatttgacaactccagcaaggtggccgctgaaccctttgacacatcttctgggtctgtgcagctcattgccataaaacccacagccctccccatggtgccccccacctcggacaggagccaggagtcatcggcagtcctcaacggcgaggtgaacaaagccctgaagcagaagtcagacatcgagcactatcggaacaagctgcgcctcaaagccaagaggaagggatattacgacttccctgcagtggagacgagcaagggtctgaccgaaagaaagaagatgtatgaaaaagccccgaaggaaatggagcatgttttggatccagattcagaactctgtgctccattcaccgagtctaaaaacaggcaacagatgaagaactctgtctacagaagccggcagtctctgaacagcccgagtccaggggaaaccgagatggaccttctggtgactcgggagcgaccccggcgtggaatccgcaacagcggatacgatactgagcctgaaatcatagaggaaaccaacattgacagagttcctgagccccggggctattccaggtctcgacaggtgaaaggccactcggagacctccacactgagctcccagccatccatcgacgaggtcaggcagcagatgcacatgctgctggaggaggccttcagcctggcatccgcgggccacgcaggccagagccggcaccaagaggcctacggctcagcccagcacctgccctattcggaggtggtgaccagcgctccggggaccatgacgcggcccagggccggggtgcagtgggtgccgacctaccgcccagaaatgtatcagtacagtctgccccggccggcttacaggttttcccagcttcctgagatggtcatgggctcaccgcctccacccgtacctccccggactggtcctgtggctgtcgcttctctcaggcgatccacctcagacatcggcagcaagaccagaatggccgagtctacagggcccgagccggcccagctgcacgacagcgcctccttcacgcagatgtccagaggccctgtgtccgtgacgcagttggatcagtcggctttaaattactcaggtaatacggtgccagcagtgttcgccatcccagctgccaacagacctggcttcaccggctacttcatcccaacgcctccctcatcctataggaaccaggcctggatgtcctatgcaggagagaatgagctcccgagccagtgggcagattcggtgcccctcccagggtacatcgaggcctacccccgatcacggtacccccagagctctccctccaggcttcctcgtcagtacagccagccagccaacctgcaccccagcctggagcaggccccggcgccctccacagcggcctcgcagcagagcctggcagaaaacgacccgtctgacgctcccctgaccaacatctccactgcggcccttgtgaaggccatccgggaggaggtggccaagctggccaaaaaacagacagacatgtttgagttccaggtctaacgccttagccccgtgggactctggacttccaaactctgaggactcagcctttgggtttcccatgcctacgtgttaggacttgagacatagcaatgggtgagtctttctcaccctccatttctgaaaaggtgaactatggggcttctgggaacaggaaactcttgaacgactagattcttggctcatccaactgattgtgggtcaagtccctggcttggggccttatgtttgatactctctcatgtcaaatgtttgaactttgggcatgtgccctatggaagcttagtcacaagaggcactagctaatctacagattcctatccaatgccacattttaataaatcaccggaagcgggagaatgtagctcttatcttcggtgacctctgcatgttaactctgtttctgtgttaaaggcaatgcaggagtgtggattaagcaccagactgtattctcattcaaccatgaccgtgcgcattaaaatcagtttgtaagggagacactgactccagccaagaaacctgagccccttttttttaggttcatattcaaagtcaaatgaactggatgaaagtcagtaccaatggctgtgcctataaatagacctgattctttgtttccctcgtcaattaaacaaaggccaagaaagagagaagatgagagggaatggtggatttgcgttgacagattttttaaaaggtgttgccattttggaaataaaagtcccctacaagttaggatctaactgaaagagaatcggtgctaagagcttttaggatcctacaaaagaaacacagttatttgtgaaggtttttctttgccttgttttgaaggtggcctgagaatggagcttctctttttcttgggataatagatacatcaacttttacaagaaaatctctgtctcttcaacaatgatgtccagtgtgtgctgctgagtggtacaaaaggaaatagtacttgattcctgttagaaacaggagtggtagaaccacagtcttcccaggccgcagcctctgtttatagaagcttctgaatgtagaaaagctgttgaatttcatttaaatgtaaataaccttttaaaaagcgtatggagttagccagttccccctagttaatggacataggaagacatttgctgaaatggtagggtggccactttgtgaccatgatgttgcaagttgccctccctggcatggtgagttggcttccagagctgtgggtagaggacatcgcctcacggcactgaggcaccagccgctgcctacccatcaatgcaagcaaaacagctactgactttgtgtagcagggagattggggactctggttccctcgccaagtgtggcagcctgtgcagtgttgggggcttacttggtatctgttggagaatgaggtcctgtcctgctttcacccatgacccatctagcttcagctgtatccattttcttctgagcccatcttccattgtcctcaacgagtttctttggtctttactgaaagaagatagtagaaatttaaaagttgagagaagactagaaatggaactgattagaaggggaggttcaaactgtcaatgcacagacttttcaaagaagttgtttatattttccaatggcaaactgccctttctggaatgttcagagatgatgtgtcatggaaccttcaaacaagtctcttgttcggatgataataggtagtgtccttttagtatgctggttgatctttcatagtgttagtgttttgttacttaaaaaggaaatcagctataaataaaatgtatttttgtaattcccgtgtgtatatatggtatatttctatcaatggccagttgttgtagtccaaaacctaaatcagtttgcaaaacactgtggacagtgcgagattttattgacaggttaacacaatgcctacgtctatccacataggcattcaatgcacttgaatgaacaaagagccaaagaaactcagcctgttcatgcaaatggtatgagtctgataaaatcagctacattgtcctgctttatcaataataatatttcattagtgcaatgatatcaaccagtactttgtctacttggtaaatgcctggaaatactgtatgtgaaaatgatgtttcaagatcttactgtaattgaagtatacgtaaatgtttcagaagacagtgtctgaaatttggctgtttcaatgacttacagagactgagtctacagtttgcagagctatggctccagagtgctaagagggtggagtcacaaatcactgtggtctttacagagccccaggaaatactgagtgagtcaactgagacgactaaaaagatagcatgctaaatcagatactgtcttaaactagacaccatgggttcaagaatagtattaatagatgagaggaaaaccttaagttggaaagaaatcagtctgttcatgttatcccactcatggggagacagagccactctggtcagattttctgtgagtgagatgtggtcccttccctgaagaatctcctaacctcatagaggtgagagagatgactggacagctgactctaagagatggtcaaaagtgcctcaaggaattgaaataaggttcccagagagccctgaggaggcagcaatgaacaaacaccctgttcatcagaaccctctagatagtcacagaagccacaaaaggaccttggttgaccttggaggaggaagcagaagtaccacgaagtggagtgactggcccagtgattcagtcccaacctcctggttcacgaacctgcttgctttccatctcgccatgtggcctgcaggcttgtcagtaacacatttctttagctgtgcctagaggtttaaaaaaaagataagggtcatatgaagaactccataatgttcttgccaagaaaaaagatgattgagtatataacgaacttcagatacagtgtatagaggatgatgcatttgtggcataataaatagttttcagtgctggttttgatatgagttttctgcattcatgaaaaagaaatgcattttggctttttccagaaagagtaccatcaaggaaacggagacctcaactgctgttctagactgtgggggtgcattcctgtctcagcaccaaggatcccaacaggcaggcagggaggcccttgactttgtgtcactgtgaggcagcagagtccatgctctgcatcaggggaggtgcagtaaaggtccattgtgtggcttgagacctatgatctgaggcttgtgcataataagatggcagctgttacctacagagcaaggagtttcctctttcagggtagattatgtaagaatcaattccctggtcccaggagaagttttattgtgagtttgttaatttaagaactcactcagcagaaggacatgtaatgtctgagtaatcttgatggaagaaaggaaatagatctgtgattaaaacacacacacacacacacacacacacacacacacaccctacttcggagagagaatgtagaatggaggaggtgaggaatttaactaatagagatgctttttctaacaggcagaaattagagaaatggatcaaaagatttaaacattgattacatataaacgagtttcctttttttctacatagcacacaggtgctcaacatttaatgaataatataacagatactgtcttaaaagtttaaaaacaggatttgtacttaatcctaaattcctcttatcacacaccagaaaataatttggattttatttacaaactacatccaaatactcttaaggaaagagtgtcatttagcttggagtagggactgactggggtctaagtgttggaaattaaattctgccattcagtccaacctcaaaggtgttccaggcaaggagttttgcaaggactagaaaccctttcacacttgaagtgcaggtgttggctgaaagaatagagggacatttcacaaacacagaacacggctcccctacaggaaagggatggagacagctacctttgctcttgctctcacattctctgtcctcatggactttcttctctgtttccctctgcctatctatctgcctggttctcttgcttctcctggccaaccagctttctcattagtgcatatgtagctgaaaaatccacccctcaagaacccactccacacaacctttccttttcagtacccaccacgctctgactagcatctctgtgatgcctaaggcaaatttttgaggatctgattggtttagttcatctgcctatgggtgagccaccctggggtcaggtgcctgtccaatcacctgttaccaaggaggcagggccgtgtcatttaagcatggccccatggactgaccctttcagcagggacttttattgggggctggtacccagaagaaggagcatgagtgggcaagaccttcaaaaagaacctactacacactggaactgactagtactcctgggatgccatgccacgcagcagccagcactcggagagcagtcccctggatactaccacacagagaaaaggggcatcttcacttgcacatcaggtgagggtgcacacacttgaaactctgctagactggccagagctgccccagccacttctcaccccaccaccagttattgatacagccgctgggtctaggaagcgatttctgaacaaggcccagttagcacaatgtcttgctcagcagacaataaatacttgtaaattgaattgcatgatcttagctcaggtgctactaatgtggctcacggccacacacttgcatggataagaaaaccaatgagcccctcaacagagtcttttgaaacaaaattggtttcaagtgaaacttacattattttttggctgtgaccttctgaatataataacttagtgtcctgagaattgaaaggcctcttgatttcttaggtgaactgttacagaatcctagcctgtggtaaatgctaaaatgtaaggtgtttctgagaaggaatatttaggaaatataattgtgccacacacacattactttagaagatatgcagttgctctgattctgcaggtttaaaaaaaatgggaagtttgtgatatggcagaatctgtctccattggtcaaaccatacttcagtgagagccattataagtgaaatctaaaaattgatcgttttcattctctgactttggtcagacttttgcaaattatggagagaggccatcaacatattttacataaattactgtggccccatcttatttctcctcatttcttccttatgtttaaacacgcccccatctcacacacaaactgagaaaagatttgtatcaaacagaatcagaggcatatgaatggactggaaattgtgaaaaaggtataaatatcctagaccttgatcaactcactttaaactggtctctgattcctcatctgtcaaatgagtataagaccctctgtacttcccatggtgattttgaggagcacatgcataatgtatctgaaaatggcttgacaagcacttgaagccattcttactaaattattagttttgtaattcggttttatccaggaaaatattttagctcctcctatctgctgaattaatttatacagtcacatgttccatgacaccatgttttgccaaggaaaaataaagaaattcctaaatttgaaattgcccacaagatctagcctcatctggagttgctgttattgtccttgttgtctatgatttggaggatatgtaagtacttgtacatgtgctttaactctgggtgaaaaaccccaaccggtgagtctttaaaaccatattagacacattgggcaaagtactgagcagaagctttgaatgtagctgttgttattttaatgcttcgctttctaatgaactttgtacgtccttagcctctgccgggaacagagtgttcatatgctgttagaattttttattgtaaaataaaatgacaaaggctttcataccccaaaa

SEQ ID NO: 5932 - DNA, 11015 bp, Homo sapiens
attccagagggcctttcggcagaacacacctcttctttggtgccttctctgcatatcaccacactgggtcaagagcaagccatcctttctggggcggttcccgcatcaccatcaactgggacagccgactttccctccatacttactttcctccagcccacagagaatcatgcctccccatctcctgtgccagaaatgcccactcttccagcagagggcagtgatgggtcccctcctgcaactagagacttgctcctctcaagcaaagttcctaatcttctttccacatcttggacatttccccggtggaaaaaggacagtgtgacagccattttagggaagaatgaagaggcaaatgtgacgattcctctccaggcctttccaaggaaagaggttttgagtcttcacactgtaaatggatttgtctctgatttcagcaccggtagtgtctcatctcccatcattacagcaccaaggacgaatccccttccttcaggaccacctctaccttccatactctccatacaagccacccagactgttttcccatctcttggcttttccagcaccaagccagaggcttatgcagctgctgtggaccattctgggttgccagcttcagcttccaaacaggtgagagcatcgccctcctccatggatgtatatgattccttaacaataggagacatgaaaaagccagcaaccacagatgttttctggagttctctttcagcagaaactggatctctttccacagaatcaataatatctggcttgcagcagcaaacaaattatgatttaaatggacacacaattagcaccacaagttgggaaactcatttagctccaacagctcctcccaatggtttaacttcagctgccgatgccataaaatctcaggatttcaaagatactgctgggcattcagtgactgcagaagggtttagtattcaggatctagtcctcggtacaagcattgagcagcctgtgcaacagtcagacatgaccatggttggaagccatatagacctctggcccacaagcaataacaaccattccagagacttccaaacagctgaagttgcatattactcacccacaactcgacattccgtgtctcatcctcagctacagttgcccaaccagccagcacatcctcttttgctaacctcaccaggaccaacttctacaggtagcttgcaggaaatgctttcagatggaacagatacaggttctgaaatttccagtgacatcaattcatcacctgagagaaatgcttccacaccattccagaacatcttgggatatcactctgctgctgaatcttctatatcgaccagtgtctttcccaggacctcctccagagtgctgcgggcttctcagcaccccaagaaatggacagcggacacagtatcatctaaggtacagccaacagcagcagctgccgtcacattgtttctgaggaaatcaagtccacctgcactgtctgcagccctggttgctaagggcaccagcagcagccctttggccgtggcctcaggaccagctaagagcagttcgatgactactcttgctaaaaatgtcacaaacaaggccgcatctggcccaaagaggacaccaggggcagtccatacagccttcccattcacaccaacctacatgtatgcaagaacaggacataccacgagcacacatacagccgcaaggaaacatggacactgcctctggcctgttgtctacaacttacctcccaggaaaccacaagccatgcacaccggcctcccaaaccccaccaacctggagatgcccagagcatccacgccacgcccactgacagtcacggccgcgctgacatccattacagcctcagtgaaggccacccggttgccaccattgcgagcagaaaacacagatgctgtccttcctgctgcatcggctgcagtggtcacgactggcaaaatggcatccaacctggagtgtcagatgtccagtaagctcctggtgaagacagttctctttctcacccaaaggagagtgcagatcagtgaatccttgaagttcagtatcgccaaagggctcacacaggcattgcggaaggctttccaccagaacgatgtctcagctcacgtggacattctggaatattctcataatgtcacagttggttattatgctaccaaagggaagttggtgtatttgcctgctgtggtgatcgaaatgctgggtgtgtatggagtcagcaacgtcactgcagacctgaagcaacacaccccacacttacagtctgtggcagtacttgcctccccatggaatccccagcctgcaggctacttccagctaaaaacagtgctgcagtttgtgagccaagcggacaacatacagtcctgcaagtttgctcagacaatggaacagaggctgcagaaggcattccaggatgccgagaggaaagtcctgaataccaaaagcaacttgacaattcagattgtgagcacgtccaatgcctcccaggcagtcaccttggtgtacgtcgtgggcaatcagagcacattcctcaacggcaccgtcgccagcagcctcctcagccagctctcggctgagctggtgggattctacctcacctatccgccgctaaccattgctgaaccactggaatatcccaaccttgacatatcagaaacaaccagagactattgggtaattacagtgctgcagggtgtggacaattcgctggtgggcctgcacaaccagagctttgcccgggtcatggagcagcgcctggcccagctattcatgatgtcccagcaacaaggccggcggtttaaacgggccaccaccctgggaagctacactgtgcagatggtgaagatgcagcgtgtcccaggcccgaaggacccagcggagctgacttactataccctgtacaacgggaagcctttgttggggaccgcagctgccaagatcctgagcaccattgattcccaaaggatggccttgacccttcatcacgttgtccttctgcaagctgaccccgtggtgaagaacccgcccaataacctgtggatcatcgctgcagtgctggcgcccattgccgtggtcacggtcatcatcatcatcatcactgccgtgctctgcaggaagaacaagaacgacttcaagcctgacaccatgataaacctgccgcagagagcaaagcctgtgcaaggctttgattatgccaagcaacacctgggccagcaaggggcagatgaggaggtcatccctgtgactcaggagacagtggttctcccactgcccattagagatgctcctcaggaaagagacgtcgctcaggatggaagcaccatcaagaccgccaaatccactgaaaccaggaagagcaggtcgcccagtgagaatggctctgtcatcagcaacgaatcagggaagcccagctcagggagacgctcaccccagaatgtaatggcacagcagaaagtgacaaaggaggaggcaaggaagagaaatgtgccagcgagtgacgaagaggagggagcggttctatttgacaactccagcaaggtggccgctgaaccctttgacacatcttctgggtctgtgcagctcattgccataaaacccacagccctccccatggtgccccccacctcggacaggagccaggagtcatcggcagtcctcaacggcgaggtgaacaaagccctgaagcagaagtcagacatcgagcactatcggaacaagctgcgcctcaaagccaagaggaagggatattacgacttccctgcagtggagacgagcaagggtctgaccgaaagaaagaagatgtatgaaaaagccccgaaggaaatggagcatgttttggatccagattcagaactctgtgctccattcaccgagtctaaaaacaggcaacagatgaagaactctgtctacagaagccggcagtctctgaacagcccgagtccaggggaaaccgagatggaccttctggtgactcgggagcgaccccggcgtggaatccgcaacagcggatacgatactgagcctgaaatcatagaggaaaccaacattgacagagttcctgagccccggggctattccaggtctcgacaggtgaaaggccactcggagacctccacactgagctcccagccatccatcgacgaggtcaggcagcagatgcacatgctgctggaggaggccttcagcctggcatccgcgggccacgcaggccagagccggcaccaagaggcctacggctcagcccagcacctgccctattcggaggtggtgaccagcgctccggggaccatgacgcggcccagggccggggtgcagtgggtgccgacctaccgcccagaaatgtatcagtacagtctgccccggccggcttacaggttttcccagcttcctgagatggtcatgggctcaccgcctccacccgtacctccccggactggtcctgtggctgtcgcttctctcaggcgatccacctcagacatcggcagcaagaccagaatggccgagtctacagggcccgagccggcccagctgcacgacagcgcctccttcacgcagatgtccagaggccctgtgtccgtgacgcagttggatcagtcggctttaaattactcaggtaatacggtgccagcagtgttcgccatcccagctgccaacagacctggcttcaccggctacttcatcccaacgcctccctcatcctataggaaccaggcctggatgtcctatgcaggagagaatgagctcccgagccagtgggcagattcggtgcccctcccagggtacatcgaggcctacccccgatcacggtacccccagagctctccctccaggcttcctcgtcagtacagccagccagccaacctgcaccccagcctggagcaggccccggcgccctccacagcggcctcgcagcagagcctggcagaaaacgacccgtctgacgctcccctgaccaacatctccactgcggcccttgtgaaggccatccgggaggaggtggccaagctggccaaaaaacagacagacatgtttgagttccaggtctaacgccttagccccgtgggactctggacttccaaactctgaggactcagcctttgggtttcccatgcctacgtgttaggacttgagacatagcaatgggtgagtctttctcaccctccatttctgaaaaggtgaactatggggcttctgggaacaggaaactcttgaacgactagattcttggctcatccaactgattgtgggtcaagtccctggcttggggccttatgtttgatactctctcatgtcaaatgtttgaactttgggcatgtgccctatggaagcttagtcacaagaggcactagctaatctacagattcctatccaatgccacattttaataaatcaccggaagcgggagaatgtagctcttatcttcggtgacctctgcatgttaactctgtttctgtgttaaaggcaatgcaggagtgtggattaagcaccagactgtattctcattcaaccatgaccgtgcgcattaaaatcagtttgtaagggagacactgactccagccaagaaacctgagccccttttttttaggttcatattcaaagtcaaatgaactggatgaaagtcagtaccaatggctgtgcctataaatagacctgattctttgtttccctcgtcaattaaacaaaggccaagaaagagagaagatgagagggaatggtggatttgcgttgacagattttttaaaaggtgttgccattttggaaataaaagtcccctacaagttaggatctaactgaaagagaatcggtgctaagagcttttaggatcctacaaaagaaacacagttatttgtgaaggtttttctttgccttgttttgaaggtggcctgagaatggagcttctctttttcttgggataatagatacatcaacttttacaagaaaatctctgtctcttcaacaatgatgtccagtgtgtgctgctgagtggtacaaaaggaaatagtacttgattcctgttagaaacaggagtggtagaaccacagtcttcccaggccgcagcctctgtttatagaagcttctgaatgtagaaaagctgttgaatttcatttaaatgtaaataaccttttaaaaagcgtatggagttagccagttccccctagttaatggacataggaagacatttgctgaaatggtagggtggccactttgtgaccatgatgttgcaagttgccctccctggcatggtgagttggcttccagagctgtgggtagaggacatcgcctcacggcactgaggcaccagccgctgcctacccatcaatgcaagcaaaacagctactgactttgtgtagcagggagattggggactctggttccctcgccaagtgtggcagcctgtgcagtgttgggggcttacttggtatctgttggagaatgaggtcctgtcctgctttcacccatgacccatctagcttcagctgtatccattttcttctgagcccatcttccattgtcctcaacgagtttctttggtctttactgaaagaagatagtagaaatttaaaagttgagagaagactagaaatggaactgattagaaggggaggttcaaactgtcaatgcacagacttttcaaagaagttgtttatattttccaatggcaaactgccctttctggaatgttcagagatgatgtgtcatggaaccttcaaacaagtctcttgttcggatgataataggtagtgtccttttagtatgctggttgatctttcatagtgttagtgttttgttacttaaaaaggaaatcagctataaataaaatgtatttttgtaattcccgtgtgtatatatggtatatttctatcaatggccagttgttgtagtccaaaacctaaatcagtttgcaaaacactgtggacagtgcgagattttattgacaggttaacacaatgcctacgtctatccacataggcattcaatgcacttgaatgaacaaagagccaaagaaactcagcctgttcatgcaaatggtatgagtctgataaaatcagctacattgtcctgctttatcaataataatatttcattagtgcaatgatatcaaccagtactttgtctacttggtaaatgcctggaaatactgtatgtgaaaatgatgtttcaagatcttactgtaattgaagtatacgtaaatgtttcagaagacagtgtctgaaatttggctgtttcaatgacttacagagactgagtctacagtttgcagagctatggctccagagtgctaagagggtggagtcacaaatcactgtggtctttacagagccccaggaaatactgagtgagtcaactgagacgactaaaaagatagcatgctaaatcagatactgtcttaaactagacaccatgggttcaagaatagtattaatagatgagaggaaaaccttaagttggaaagaaatcagtctgttcatgttatcccactcatggggagacagagccactctggtcagattttctgtgagtgagatgtggtcccttccctgaagaatctcctaacctcatagaggtgagagagatgactggacagctgactctaagagatggtcaaaagtgcctcaaggaattgaaataaggttcccagagagccctgaggaggcagcaatgaacaaacaccctgttcatcagaaccctctagatagtcacagaagccacaaaaggaccttggttgaccttggaggaggaagcagaagtaccacgaagtggagtgactggcccagtgattcagtcccaacctcctggttcacgaacctgcttgctttccatctcgccatgtggcctgcaggcttgtcagtaacacatttctttagctgtgcctagaggtttaaaaaaaagataagggtcatatgaagaactccataatgttcttgccaagaaaaaagatgattgagtatataacgaacttcagatacagtgtatagaggatgatgcatttgtggcataataaatagttttcagtgctggttttgatatgagttttctgcattcatgaaaaagaaatgcattttggctttttccagaaagagtaccatcaaggaaacggagacctcaactgctgttctagactgtgggggtgcattcctgtctcagcaccaaggatcccaacaggcaggcagggaggcccttgactttgtgtcactgtgaggcagcagagtccatgctctgcatcaggggaggtgcagtaaaggtccattgtgtggcttgagacctatgatctgaggcttgtgcataataagatggcagctgttacctacagagcaaggagtttcctctttcagggtagattatgtaagaatcaattccctggtcccaggagaagttttattgtgagtttgttaatttaagaactcactcagcagaaggacatgtaatgtctgagtaatcttgatggaagaaaggaaatagatctgtgattaaaacacacacacacacacacacacacacacacacacaccctacttcggagagagaatgtagaatggaggaggtgaggaatttaactaatagagatgctttttctaacaggcagaaattagagaaatggatcaaaagatttaaacattgattacatataaacgagtttcctttttttctacatagcacacaggtgctcaacatttaatgaataatataacagatactgtcttaaaagtttaaaaacaggatttgtacttaatcctaaattcctcttatcacacaccagaaaataatttggattttatttacaaactacatccaaatactcttaaggaaagagtgtcatttagcttggagtagggactgactggggtctaagtgttggaaattaaattctgccattcagtccaacctcaaaggtgttccaggcaaggagttttgcaaggactagaaaccctttcacacttgaagtgcaggtgttggctgaaagaatagagggacatttcacaaacacagaacacggctcccctacaggaaagggatggagacagctacctttgctcttgctctcacattctctgtcctcatggactttcttctctgtttccctctgcctatctatctgcctggttctcttgcttctcctggccaaccagctttctcattagtgcatatgtagctgaaaaatccacccctcaagaacccactccacacaacctttccttttcagtacccaccacgctctgactagcatctctgtgatgcctaaggcaaatttttgaggatctgattggtttagttcatctgcctatgggtgagccaccctggggtcaggtgcctgtccaatcacctgttaccaaggaggcagggccgtgtcatttaagcatggccccatggactgaccctttcagcagggacttttattgggggctggtacccagaagaaggagcatgagtgggcaagaccttcaaaaagaacctactacacactggaactgactagtactcctgggatgccatgccacgcagcagccagcactcggagagcagtcccctggatactaccacacagagaaaaggggcatcttcacttgcacatcaggtgagggtgcacacacttgaaactctgctagactggccagagctgccccagccacttctcaccccaccaccagttattgatacagccgctgggtctaggaagcgatttctgaacaaggcccagttagcacaatgtcttgctcagcagacaataaatacttgtaaattgaattgcatgatcttagctcaggtgctactaatgtggctcacggccacacacttgcatggataagaaaaccaatgagcccctcaacagagtcttttgaaacaaaattggtttcaagtgaaacttacattattttttggctgtgaccttctgaatataataacttagtgtcctgagaattgaaaggcctcttgatttcttaggtgaactgttacagaatcctagcctgtggtaaatgctaaaatgtaaggtgtttctgagaaggaatatttaggaaatataattgtgccacacacacattactttagaagatatgcagttgctctgattctgcaggtttaaaaaaaatgggaagtttgtgatatggcagaatctgtctccattggtcaaaccatacttcagtgagagccattataagtgaaatctaaaaattgatcgttttcattctctgactttggtcagacttttgcaaattatggagagaggccatcaacatattttacataaattactgtggccccatcttatttctcctcatttcttccttatgtttaaacacgcccccatctcacacacaaactgagaaaagatttgtatcaaacagaatcagaggcatatgaatggactggaaattgtgaaaaaggtataaatatcctagaccttgatcaactcactttaaactggtctctgattcctcatctgtcaaatgagtataagaccctctgtacttcccatggtgattttgaggagcacatgcataatgtatctgaaaatggcttgacaagcacttgaagccattcttactaaattattagttttgtaattcggttttatccaggaaaatattttagctcctcctatctgctgaattaatttatacagtcacatgttccatgacaccatgttttgccaaggaaaaataaagaaattcctaaatttgaaattgcccacaagatctagcctcatctggagttgctgttattgtccttgttgtctatgatttggaggatatgtaagtacttgtacatgtgctttaactctgggtgaaaaaccccaaccggtgagtctttaaaaccatattagacacattgggcaaagtactgagcagaagctttgaatgtagctgttgttattttaatgcttcgctttctaatgaactttgtacgtccttagcctctgccgggaacagagtgttcatatgctgttagaattttttattgtaaaataaaatgacaaaggctttcataccccaaaa

SEQ ID NO: 5933 - DNA, 2430 bp, Homo sapiens
acgtctctttgtggtggcgttgagctcctctagcccgcgcttgccgtcctctcagtggtagcgcggggactggctgggaagcggtcggtcgagtgtggcctgtgtggactcgcatcttgcccgaagccgggcggaggagagctcaagctaagggtgatcagcccatgacctaaacctccagacaaaataaaacggaaaatttgctagaatcaagaatgatggatccatgttcagttggagtccagcttcgtactacaaatgagtgccataaaacctactatactcgtcacacaggttttaagactttgcaagaattgtcatcaaatgatatgcttttacttcaacttagaactggaatgacactttctgggaacaatacaatttgctttcatcatgtaaaaatttacattgacagatttgaggatttacagaagtcatgttgtgacccatttaacatacacaagaaattagccaaaaaaaatttgcatgtaattgacttagatgatgccacttttctgagtgctaaatttggaagacagcttgtacctggttggaagctttgtccaaaatgcacacagataatcaatggaagtgtggatgttgatactgaagaccgccagaaaaggaaacctgagtcagatggaagaactgctaaagctttgaggtcattacaatttacgaatccaggaaggcaaactgaatttgctccagaaactggtaaaagagaaaaaagaaggcttacaaaaaatgcaaccgctggttcagacagacaagtgataccagcaaagagtaaggtctatgatagccagggtctcctgatttttagtgggatggacctctgtgactgcctggatgaagactgcttaggatgtttctatgcttgtcctgcctgtggttctaccaagtgtggagctgaatgccgctgtgaccgcaagtggctgtatgagcaaattgaaattgaaggaggagaaataattcataataaacatgctggataatctgcggtaccaaactatggagcctttaaaggtctttatttctaaaaatctgttactctaagatacattttaagcttgattatcatatgacaaagattttaaaaccatctcagtgtgccctaatttttcatcatgggtgctttaagattcactatttgatataaattcagataggctatttttcagtagtcagcgttaagcctgtctggatcaatataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaatctaggttaaaattttagttagcacattgtaactgagtaattacatgaagtacaaacctctctgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattctatagaagtgaacactcgaaagaactggtcaacaaagatgaaagtgcagcaaagcaatgaaaaatgataacactggaagtgaaattttaatcaaacataaatgaatttgtagaagaagtcactgaccatgggaatgttgttcttgctgctgtgtattcataggagcttagtgaaggcaaacttaccaacacaaataagcaaagtggttgcaataaagacagatacgtcccagaggaagtgatggttaaaaaaaaaaaactttacattaaaagatatttaatgtgaatatagaaatatttcacaacattgaaagcacaagcaataaaagggtggaagctgacccaaacttagaaggagtatggcagtttgccgtgaacataaaagatgcttactcagtatggtaagttacttgccagaaaaaaaggcaagccctattcaaactactttgtttttacaatgaaataaaacactttaattctatttctaatgttttaaattacagtgtactaaatatttttaaacatttttgcatttttttctacatttataactggtcttaagagtttttaatatttgagcagaaccttaaaggtcatggaacaatcatcattttccctattgattattaagattgcaggaccatttttatggtcccacagtaccatgtgaaatgaggatcgcttgtagctgggaacagtgcttacttcagggaaaactgattttgatagaaccgactagttgagtattaaactgttttggaaataatttatatatctaagtgctgaaatatatttctcttctccccacttattcaaataaaaaagttttaatactataaa

SEQ ID NO: 5934 - DNA, 3417 bp, Homo sapiens
atacattgccacatagttcgttgccttgtaactttacctctgatttcctttttctcctccttaatttatcttaatccaattatctgtttgaagaaaaaaaaaattttttttatttttttattttttgagatgagagtctcgctttgtcgcccgggctggagtccagtgacacgatctcggctcaccgcaacttccgcctcctgggttcaagcgattctcatgcctcaacctcccatatagctgcactaccacacctgactaatatttttgtatttttagtagacacgagatttcactatgttagccagtctagtctagaactcctggcatcaagtgatcaacccacattggcctcccaaagtgctgggattacaggcaggagccacaatgcctggctagaagaaacttttctaattattactgtgatagaagccattttatctgatttgattgggacctgtattagttcattttaaaaactgactaaaacacagtaaatgaatataaatatactctgtttttaccagctttaaaacttttttcagttaaaatgttcagtaacatattttaacactttaaagtgtattttattttttaactttgtaaatacagtattttgacctaaaacacagacatttattcgccattttttgttacctgaggccagagtcttctttttatatgattttgctgattattgtttttctctgcagaaaccatatcaaaatgtgtttaagatttctctccagtttttgttttttttttaattttgcaaagcttaaaaacacttgtaaaattgctgaatcctagacttcacagtccctccctaccactcagatttcagtggttcacattttttctcaacagcagattttttcctaatgagttgcattggttgcatattttcttgagaatccaacttttttttttaatttgctttgaaaattatttatgaaaaatttcaaatagaaagtatggacagtagtgaagcacttatgtacatgtcaccaaaccttattttctgtaaatctttttggggaaaataatgttttttcccctcagaagtatccacaaatgtgatatatgttactcttatgtatattttagtatatattcatgtttcatctgtaaatcttatgtactatcttatctttttaaattttacctttaatgatgatactatataacctttacaacttttttcacttaagattgtctttgagatttattcatgttgattcacgtaattcatgtagtttattcattttaactgttatgtgggagtcccttgtatgagtaacgatttcacatcctttacaattaggttatttgtcatctttcactgccaaaggcagtgaatgctgaaagttttcgtatataacttgtgctcttattggagatatttttctccatctgacacccagaactgaaaagagctgagtcccaaggtgtatgcttcctcagttttacaagaaattgcagaaaatgttctaaagcagttgcagcaatttacattcctaccaaagttattataaggagcatgtgagagttggacacatcttaaccagatatcagatttttaaattgatttcaagcaaatgtttaataaatgatatttaatttgcattttcctaggaactatgggggaaacagtttgtatgcatgtattggcttttgttctctttctctgtgaattgcctgactatatttgtttagttttccagtggactctgtcattttctaattgatttttggaagtgaggagttactcgaatatttatgataataatcctaacacctttcaagtgtctttttttttctcctttagttatacagaaatgtgtaaattttacatataatcaaatatatccatctttttatttatttatttttttggtatctgcttgcttgtttgaaaaattcttccatacttccatgtcagaaaaccttctttattttctcataaacatgtttagtttttcttttcatgtttaaatctttaatccacttgttattgatttttgtttgtgcagaagagatctaattgtttttccatatggttaaagtcccttcttcattagtgtgtgatacccatcgattaatagtaccacatgtcatatactgagccctcatctactcatggatctgtttgtttatactataccaataccatagttttaattagaataggtttaaagtaaatcaatatgttactgtattttccttcaggattaccttggctttcttagacctttgctctttcatatagaccagcttgctaaattccaagggggtggcagtagaatatctgatggaactttgattgtaacagaactgaatttacagatgtattcccagataattgacatattttttataatgagccactccatgatatatagctgcatttatttagggtaccgtttttgtcttgcagtttgataattttctccatgaaggtcttgttgtatgtcttttgtaagagtcacatattttgtaagatacagtgttttttggtttctagcatccctggtgaattctcttattagttctaatagtttgttaaacctcttgtatttctcatgtatcttaggataatatttcttatttcctcctttttaattcttatgtggtcttaaatataatctgtaattgcagatgttttcgtgaagttctgactttacagggaacgcttctgtttgattattaaatgtctattataagacttcgataaataccttttttattccttattttcttttagataggtgttgaattttatcaaatgctttttcagtttcctagataaacttgcagcacaaatttgattctctttaatattttctctagggtgatcagcccatgacctaaacctccagacaaaataaaacggaaaatttgctagaatcaagaatgatggatccatgttcagttggagtccagcttcgtactacaaatgagtgccataaaacctactatactcgtcacacaggttttaagactttgcaagaattgtcatcaaatgatatgcttttacttcaacttagaactggaatgacactttctgggaacaatacaatttgctttcatcatgtaaaaatttacattgacagatttgaggatttacagaagtcatgttgtgacccatttaacatacacaagaaattagccaaaaaaaatttgcatgtaattgacttagatgatgccacttttctgagtgctaaatttggaagacagcttgtacctggttggaagctttgtccaaaatgcacacagataatcaatggaagtgtggatgttgatactgaagaccgccagaaaaggaaacctgagtcagatggaagaactgctaaagctttgaggtcattacaatttacgaatccaggaaggcaaactgaatttgctccagaaactggt

SEQ ID NO: 5935 - DNA, 1104 bp, Homo sapiens
ggggaagagggggcgggagccgaggcccgggcgggggcagccagcgagttagggttaggacgggaggattcggcttcccggcggcagagggcgcctggcgctgcggtctggcgcgccagagtcgcccgcgcgggcgccgagaggagaggcgaggcggggagcgcaagcggcggcggccactgccacgtattcccggcagtggtggcggcggcggcggcggcgcccgcgggcaggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtgtttgtgtacgtggccacgcgccccaccatcaccgagtgagccccgcagccggctgcggaccccatcggcagggagaggaggcgcgggagggggacgcaaacaaaaaatggctttcatattcagagatgttcatgttgctgagctgtaagcaggagcaccctgtcttctctggtctttgacttgattaaagtatctccgctttcttgggagggaataggggatgttttatcagtgaatgtgccatacaccttatggtccacttcatgtgcctttcagacttcaaagcgcgcgcgcatgtgtgtgtgtgtgtgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcttctttccaacacgtgttcacaatctccaaagggactgtatttcttctctgtgcttaatgtgatttgaaatatgttgaatcaaagtgaaatatttattttttgaataaaggagataatagccttaaa

SEQ ID NO: 5936 - DNA, 889 bp, Homo sapiens
caggaataactcaagtcacctgtactggaaatcagtttgctgaaattaatcaacgattcttgaagttgaagaaaagttgttctctctacaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtgtttgtgtacgtggccacgcgccccaccatcaccgagtgagccccgcagccggctgcggaccccatcggcagggagaggaggcgcgggagggggacgcaaacaaaaaatggctttcatattcagagatgttcatgttgctgagctgtaagcaggagcaccctgtcttctctggtctttgacttgattaaagtatctccgctttcttgggagggaataggggatgttttatcagtgaatgtgccatacaccttatggtccacttcatgtgcctttcagacttcaaagcgcgcgcgcatgtgtgtgtgtgtgtgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcttctttccaacacgtgttcacaatctccaaagggactgtatttcttctctgtgcttaatgtgatttgaaatatgttgaatcaaagtgaaatatttattttttgaataaaggagataatagccttaaa

SEQ ID NO: 5937 - DNA, 374 bp, Homo sapiens
gcggggagcgcaagcggcggcggccactgccacgtattcccggcagtggtggcggcggcggcggcggcgcccgcgggcaggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtg

SEQ ID NO: 5938 - DNA, 472 bp, Homo sapiens
ggaggaagccaggttacctctgttggacctgcctgctcccagcatctccagcaacaagctgtctctgccggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtgtttgtgtacgtggccacgcgccccaccatcaccgagtgagccccgcagccggctgcggaccccatcggcagggagaggaggcgcgggagggggacgcaaacaaaaaat

SEQ ID NO: 5939 - DNA, 355 bp, Homo sapiens
cctcttcaaagacctaatcagcgtctagtgggaataactcaagtcacctgtactggaaatcagtttgctgaaattaatcaacgattcttgaagttgaagaaaagttgttctctctacaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtgctgcccacgctggccgtggtcgtgctcttgatcgtggtgtttgtgtacgtggcc

SEQ ID NO: 5940 - DNA, 5745 bp, Homo sapiens
cacagggcctgcagagaggggacccaccgggcaggatgcactggcttccagcaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatccccccccagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgaccctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaagctggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggcaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctg

SEQ ID NO: 5941 - DNA, 5927 bp, Homo sapiens
agccgggactgtcgcgcgggccgcgccggcgatgccgcgcccccgggccgggctgtagcggggccgcggctggagtgtgcgccgggcaggcgggacatggaggtggtggacgagacggaggcgctgcagcgcttcttcgaaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatccccccccagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgaccctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaagctggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggctcttttgccgtgtccacttcctgtctcctggccctgctccggccccagccccctggggggagtgaggccttgtgcccatggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagcctctctccttgcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctga

SEQ ID NO: 5942 - DNA, 1449 bp, Homo sapiens
atgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggactggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggtctgtgggctgaaatacgtggtttattgtgaggacgacgtttgtcacttacctgtcctgagtctgggcgccaaggaggcatgggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaaggtagggtcatcgtccgtggttccggaccaggcctgcatcagccagcgcttcctgcagggaaccatcattgccctggtggtggtcatggccttcaggcatcacctgggagcccagcctcaggagcaaggaccacagccttgtcctagagagagggcactggatggtggctccagctctaacggtcacccttttctgtggctccagcgtggtgtccatgtccacactgtacgtgctgagcctgcgcacagaggaggacctggtagacactga

SEQ ID NO: 5943 - DNA, 1920 bp, Homo sapiens
acaatcctttgcggtggttcaagatggcggcgcccagtggcacagtgagcgattcggaaagtagtaacagcagtagcgatgcggaggagctggagcggtgccgcgaggcggcaatgccggcttggggcttggagcaacgcccgcacgtggcagggaagccaagagccggtgctgcaaatagccagttgtcaacctcccaaccgagcctcaggcataaggtgaatgagcatgaacaagatggcaacgagcttcagaccacccctgaattccgagcccacgtagccaagaagctgggagccctgctggacagcttcattaccatctcagaagcagcaaaggagccagcaaaagctaaggtacagaaagtcgctttggaggatgatggtttccgccttttcttcacatctgtccctggaggccgtgagaaggaagagtctccccaaccccgccgaaagcgacagccctccagctccagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccagaacatttcatgacctcaggaaaaaaggaaccttccagttatttgagactagtggccaagtggtgaaacctccatctccctagaactgtctgaggtgggcaggggaagggagaccttccccaccacctccttagcctggtgtgagaaacagtttttagaaaatgagagaagggatccccaagaggccaaggcccagagaaacttttgttcttctctccttagcccacatagacttcacagaatcgtctgagaaaggagagctttttcacccctggctttctagaattttctttgtctgcatttgtgaatataccacacatgatggtgtctctgagccgaccagattatggaaactcaattgtcagaggacccaaaacaaaacttagagtgatttggatattgcctctctgtcaatgctgaaccttaagacattttaagtaaacatcctcctcctctctacacccccaggatttgtgcgttcaccccacccaagacttcaggaagtgtcatagcactcgtggactaggtttcatgggacaaaggcattctgcaagaagtagaagcttgtggccgggtgcagtggctcatgcctgtaatccaagcattttgagaggccaaggaggtggatcaattgaggccaggagtttgagaccagcctggccaacatggcgagaccccatctctactaaaaatacaaaaattagctgagcatgttgacacacgcccgtaatcccagctactcaggaggctgaggtgggagaatcgcttgaacccaggaggtgcaggttgcagtgagccgagattgcgccactgcactctagcctaagcaatggagcaagaccctatctc

SEQ ID NO: 5944 - DNA, 1339 bp, Homo sapiens
gcggtggttcaagatggcggcgcccagtggcacagtgagcgattcggaaagtagtaacagcagtagcgatgcggaggagctggagcggtgccgcgaggcggcaatgccggcttggggcttggagcaacgcccgcacgtggcagggaagccaagagccgtagagatggggtttcaccatgttgaccaggatggtctcgatctcttgacctcgtgatccgcctgcctcagcctcccaaagtgctgggattacaggcgtgagccaccgcgcccggccttgactccatcttaaaagtgcatctatctggagttcacccacttctcaccacatcaattactgcagcagactccgtgttcctgcctttgccccaacagtctcacgctgcacagcagccaaagatgttctgtcaaaacccaggtgctgcaaatagccagttgtcaacctcccaaccgagcctcaggcataaggtgaatgagcatgaacaagatggcaacgagcttcagaccacccctgaattccgagcccacgtagccaagaagctgggagccctgctggacagcttcattaccatctcagaagcagcaaaggagccagcaaaagctaaggtacagaaagtcgctttggaggatgatggtttccgccttttcttcacatctgtccctggaggccgtgagaaggaagagtctccccaaccccgccgaaagcgacagccctccagctccagcagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccagaacatttcatgacctca

SEQ ID NO: 5945 - DNA, 2515 bp, Homo sapiens
gcggtggttcaagatggcggcgcccagtggcacagtgagcgattcggaaagtagtaacagcagtagcgatgcggaggagctggagcggtgccgcgaggcggcaatgccggcttggggcttggagcaacgcccgcacgtggcagggaagccaagagccggtgctgcaaatagccagttgtcaacctcccaaccgagcctcaggcataaggtgaatgagcatgaacaagatggcaacgagcttcagaccacccctgaattccgagcccacgtagccaagaagctgggagccctgctggacagcttcattaccatctcagaagcagcaaaggagccagcaaaagctaaggtacagaaagtcgctttggaggatgatggtttccgccttttcttcacatctgtccctggaggccgtgagaaggaagagtctccccaaccccgccgaaagcgacagccctccagctccagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccagaacatttcatgacctcaggaaaaaaggaaccttccagttatttgagactagtggccaagtggtgaaacctccatctccctagaactgtctgaggtgggcaggggaagggagaccttccccaccacctccttagcctggtgtgagaaacagtttttagaaaatgagagaagggatccccaagaggccaaggcccagagaaacttttgttcttctctccttagcccacatagacttcacagaatcgtctgagaaaggagagctttttcacccctggctttctagaattttctttgtctgcatttgtgaatataccacacatgatggtgtctctgagccgaccagattatggaaactcaattgtcagaggacccaaaacaaaacttagagtgatttggatattgcctctctgtcaatgctgaaccttaagacattttaagtaaacatcctcctcctctctacacccccaggatttgtgcgttcaccccacccaagacttcaggaagtgtcatagcactcgtggactaggtttcatgggacaaaggcattctgcaagaagtagaagcttgtggccgggtgcagtggctcatgcctgtaatccaagcattttgagaggccaaggaggtggatcaattgaggccaggagtttgagaccagcctggccaacatggcgagaccccatctctactaaaaatacaaaaattagctgagcatgttgacacacgcccgtaatcccagctactcaggaggctgaggtgggagaatcgcttgaacccaggaggtgcaggttgcagtgagccgagattgcgccactgcactctagcctaagcaatggagcaagaccctatctcaaaaaaaaaaaaagaaaaagaaaaagaaaagaagtagaagctcatggccagggatggtggctcacacctgtaatcccagcactttgggaggccgaggcaggtggatcacttgagccgagttccagaccagcctaggcaacatggtgaaacctcgtctctataaaaaaaagaatacaaaaattagttgggcatggtagtgagcgcctgtgaggctgcttgtgaggctgaggtgggaggatccctttagtccaggagttcaaggctgcagtgagctgtataatgccactgcagtccagcctgggtgacagtgagaccctgtctccaaaacaaaatttttttaaaaagtagaagcttgaggttaagatgaaatctggctttgtcattagagtctcagcagagcaagaaaagcagagatgtggggtgtgagagcgtgggtgctggagcctgtctcctcttcgcaggcctctggcctgccccagcctcccgctacctgcccaaaccccatctgaatgatttgtggacaagcaagaagtttccaccgcatttctccttgactttactaaaagttaaataaacgtgccactcgccccggctggctacaagct

SEQ ID NO: 5946 - DNA, 3189 bp, Homo sapiens
gaactgtattcagcggcgacagcggcgactgcggcggccgcgggagggcatcccgttggggatccttccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacaggagagacggggtttcaccatgttagccaggatggtctcgatctcctgacttcgtgatccacccgcctcggcctcccaaagtgctaaaattacaggcgtgaaccaccaccacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagcattgcagggggtcaaatactgtcagtgataaagatgcaactgattaaaggccaaaacagcagggatcctttttgcaaagcaatagaggaagttgctcaggatttggatttgaggattaaaaatattatcaattctcaagaaggtgttgtagctcttagcaccactgacatcagtcctgctcggccaaaatctcatgccataaaccatggtactgcatactgtggcagagatactgtgaaagccttattagttcttttggacgaagaagcagctaatgctcctaccaaaaacaaagcagagcttttatatgatgaggaaaacacaatccatcatcatggaacgtctattcttacactttttaggtctcccacacaggtgaataattcgataaaacccctaagagaacgcatctgtgtgtcaatgcaagagaaaaaaattaagatgaagcaaactttaattagatcccaatttgcttgtacttataaagatgactacatgataagcaaggataattggaataatgttaatttagcatcaaagcctttgtgtgttctttacatggaaaatgacctttctgagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaagcattgtttaaaaatactagtaagtcataattatgcagaattttcacaaagtttaatgcacagagaaagcatatcatttcagttactgatacatcttaacactactttcttttaaaacagacatttaacatacacaagttatagtagcagtatgggcttctcctcccattggcaattaaatgcttttattttcttctgaaaagatgatgtggaccaacaggtatcagacttgccaacaaggtcggtagactcttcccagcatacatctgagcactgaaggaagaagaaagtttaaattgtttaaaggactataattatcacacaaaatttattaagaaaaaaagaatggatctagtataactaattctgagtaaaccaaaatgataataattaattgttgctatttaatcccacatttttggcaggtgtaattgagccatggtcttatttgattttgttatgattgcatccaaattcactttaactcagagttctgtttaatggtggtaggatgtaagaattgaattttgaaaagactactcactgtcaaaatctctccttcctataggaaatttagctgagttttcttcatccccaatttctctcttttcttgtgttgattcagtattctgaactccattctcagctgggaaagctacagatccttttagtgcaagataaggttttatagccagattcagtggcagaccatgatttaagaaattatgtttggagcctgtgttctgtaaagagaaggttgatttggtttttagctatcgtattcggagtggaactataatacaattgtataatattcttgttgatcaattcaaagttactctgcactgtttttgactttttaaaaataccttagatgcaaatttataggagaaaaaacactttcagataagaggtgtttgctgggatggaagaactacctggcatgtaagaaatatcgtcagtcgtcctaatgcatattgtgactgtttgcatatacttctgtttataaaagtatcagttttacttttcagaggatttgtaagaatcatttaaattttcattgaaataaacgacaagtcacattgccactta

SEQ ID NO: 5947 - DNA, 2086 bp, Homo sapiens
ccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagcattgcagggggtcaaatactgtcagtgataaagatgcaactgattaaaggccaaaacagcagggatcctttttgcaaagcaatagaggaagttgctcaggatttggatttgaggattaaaaatattatcaattctcaagaaggtgttgtagctcttagcaccactgacatcagtcctgctcggccaaaatctcatgccataaaccatggtactgcatactgtggcagagatactgtgaaagccttattagttcttttggacgaagaagcagctaatgctcctaccaaaaacaaagcagagcttttatatgatgaggaaaacacaatccatcatcatggaacgtctattcttacactttttaggtctcccacacaggtgaataattcgataaaacccctaagagaacgcatctgtgtgtcaatgcaagagaaaaaaattaagatgaagcaaactttaattagatcccaatttgcttgtacttataaagatgactacatgataagcaaggataattggaataatgttaatttagcatcaaagcctttgtgtgttctttacatggaaaatgacctttctgagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaagcattgtttaaaaatactagtaagtcataattatgcagaattttcacaaagtttaatgcacagagaaagcatatcatttcagttactgatacatcttaacactactttcttttaaaacagacatttaacatacacaagttatagtagcagtatgggcttctcct

SEQ ID NO: 5948 - DNA, 2503 bp, Homo sapiens
gaactgtattcagcggcgacagcggcgactgcggcggccgcgggagggcatcccgttggggatccttccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaagcattgtttaaaaatactagtaagtcataattatgcagaattttcacaaagtttaatgcacagagaaagcatatcatttcagttactgatacatcttaacactactttcttttaaaacagacatttaacatacacaagttatagtagcagtatgggcttctcctcccattggcaattaaatgcttttattttcttctgaaaagatgatgtggaccaacaggtatcagacttgccaacaaggtcggtagactcttcccagcatacatctgagcactgaaggaagaagaaagtttaaattgtttaaaggactataattatcacacaaaatttattaagaaaaaaagaatggatctagtataactaattctgagtaaaccaaaatgataataattaattgttgctatttaatcccacatttttggcaggtgtaattgagccatggtcttatttgattttgttatgattgcatccaaattcactttaactcagagttctgtttaatggtggtaggatgtaagaattgaattttgaaaagactactcactgtcaaaatctctccttcctataggaaatttagctgagttttcttcatccccaatttctctcttttcttgtgttgattcagtattctgaactccattctcagctgggaaagctacagatccttttagtgcaagataaggttttatagccagattcagtggcagaccatgatttaagaaattatgtttggagcctgtgttctgtaaagagaaggttgatttggtttttagctatcgtattcggagtggaactataatacaattgtataatattcttgttgatcaattcaaagttactctgcactgtttttgactttttaaaaataccttagatgcaaatttataggagaaaaaacactttcagataagaggtgtttgctgggatggaagaactacctggcatgtaagaaatatcgtcagtcgtcctaatgcatattgtgactgtttgcatatacttctgtttataaaagtatcagttttacttttcagaggatttgtaagaatcatttaaattttcattgaaataaacgacaagtcacattgccactta

SEQ ID NO: 5949 - DNA, 1916 bp, Homo sapiens
gcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagcattgcagggggtcaaatactgtcagtgataaagatgcaactgattaaaggccaaaacagcagggatcctttttgcaaagcaatagaggaagttgctcaggatttggatttgaggattaaaaatattatcaattctcaagaaggtgttgtagctcttagcaccactgacatcagtcctgctcggccaaaatctcatgccataaaccatggtactgcatactgtggcagagatactgtgaaagccttattagttcttttggacgaagaagcagctaatgctcctaccaaaaacaaagcagagcttttatatgatgaggaaaacacaatccatcatcatggaacgtctattcttacactttttaggtctcccacacaggtgaataattcgataaaacccctaagagaacgcatctgtgtgtcaatgcaagagaaaaaaattaagatgaagcaaactttaattagatcccaatttgcttgtacttataaagatgactacatgataagcaaggataattggaataatgttaatttagcatcaaagcctttgtgtgttctttacatggaaaatgacctttctgagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgtatctataaaccattcaccaaagacatgcttaatttttaagagatcaaggtgtaaattatgatgatttattattttggtctacagtgtatgtaaggttagtatgttaag

SEQ ID NO: 5950 - DNA, 1361 bp, Homo sapiens
ggggaggtagcccgcagtgcaggggcagcgcggcgcggggccaccgacgggacgcggctccgggaacatggctcgcttcgctctgactgttgtccggcatggagaaacaagatttaacaaggagaaaataatccaaggacaaggagtagatgaacctctttcagaaactggatttaaacaagcagcagctgctggtatatttctgaataatgtgaagtttactcatgctttctccagtgatctcatgaggacaaagcagaccatgcatggaattttggagagaagcaaattttgcaaagatatgacggtaaagtatgactcaagacttcgggaaaggaaatacggggttgtagaaggcaaagcgctaagtgagctgagggccatggccaaagcagccagggaagagtgccctgtgtttacaccgcccggaggagagacgctggaccaggtgaaaatgcgtggaatagacttttttgaatttctttgtcaactaatcctgaaagaagcggatcaaaaagaacagttttcccaaggatctccaagcaactgtctggaaacttctttggcagagatatttcctttaggaaaaaatcacagctctaaagttaattcagacagcggtattccaggattagcagccagtgtcttagttgtgagtcacggtgcttacatgagaagtctgtttgattattttctgactgaccttaagtgttccttaccagccactctgagcagatctgaacttatgtcagtcactcccaatacagggatgagtctctttatcataaactttgaggaaggaagagaagttaaaccaacggttcagtgtatttgtatgaacctacaggatcatctaaatggactgactgaaactcgctaaggttaaatctgcatcaaaatctaaccattttgagcctctgaagggagtgccattggctttatttacttctctcctctgctagttctgatttggaaacagttaaaagccaatttttagctccagtggaaccatagccacataaaactttaatggacaaccatatagaattaacttattttgtccaagtacagttggcattttccagaataattttaccaccctgctagatgtcatctctggattgcacatggatgatgaaggaactcagcattgaaagttgggggattagtaaccttgttacaacggtttctttttcattttagcctattttaatggctattggtaagatactgtatgtttttagtatctcatccagtgcttagaagaaagaatggtttataattcccagtacatgtttatattgactgtgttatatttttaaatcctttaaataaaaaatccttataagtttatgtaaagc

SEQ ID NO: 5951 - DNA, 2073 bp, Homo sapiens
cacacgccgaagggctccgagggggtcaggccaatcggcagccgtcaccccacaccccagcccatcaccacactcaaggggccgctaagacagtgtctcctaagtctcgtctcctgtccccagcggcctacagctccctgcaggctggtggccgcttacctggccgccgctcccgctgccgatgtcagggtcatgcaagcggcctctcgcgaccgttacccgagggagcgcgcgcgcgcccggcgtctctccagtgattggctgcccggaaggaggcggagacagcctcgcatggcgcgcgcgtccacctcgccgttccccctcgcgcagctccaaccaaagagagacatccaaccccgggggagtgacaagggggcgggattgctgtgaaactctcttctctgattggctctctgggagccagccgctgccacgagggaaagaagcttcagtttctcgcatgcgcagtgagtaaacatgagcctctggtagataagagaaaccgcgatcggagtacggcgcgtgcgcagatcagggatcgcgattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaaagtagatgttttctacaatggtgaaaacagtcctgttcacaaagaaaaacgagaagcggcgaagaaaaaacaagaaaggaaaaaaagagcaaaggaaaccctggaaaaaaagaagctacttaaagaactgtgggagtcaagtaaaaaggtccactgagaaaagaattagagattccaactgacagaatctgccagaagctcccagggaataatggtggcgagttccatcaccagcattattatagtgcttcaaaagaaatatttttgatgaacttaaaagacaacaaatttatttaaatggtgcactaaactgtagtgaacagagacatgcacgattcaagaataaaactcggctgggcacggtggacggtgcctcacatctgtaatcccagcactttgggaggccgaggcgggcggatcacttgaggtcaggagtttgagaccagcctggccaacatggtgaaaccccgtctctactaaaaatacaaaaaattagccaggcatggtggcgggcacctgtaatcccagctactcgggaggccgaggcaggagaattgcgtgaacctgggaggcggaggttgcagtgagctgagatcgcgccactgcactcaagcctgggcaacacctgggtgacagagcgagaccccatctcaaaaaaaaaataaaactagttcaagtgcaatgacacacgcctataatcccagcaccttgggaggctaagacaggaagatcacctgagcccaggagctcaagattgcagtgagctatgaacaccactgcactccacctgtccacttgttcttgtgtgacagaacaagaccctgtctctaaaaaataagataaaaccataaagaaacacagtcagtactatacaagaataatggctacttctagagggaaggagttgtcattgtgatgaggcacttggaggggttctggggtgcctgacaaagttctgtttcttcacctgggtggtagttagaagggtgtccccgtatttcaaattgtacctttgtgagattgtatgttttgtaataataaaattttttttgtaattagtaaagtcaatttttatggagaactgg

SEQ ID NO: 5952 - DNA, 1575 bp, Homo sapiens
cctggggctgttcaggcactcagggcaggggagaggagagactaccgtcctggagataacggttccacggaggcccaaggcgaaacggaaggatcctcatgtacaaaactgagcggaatggagctgtgagcacgcatcaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaaagtagatgttttctacaatggtgaaaacagtcctgttcacaaagaaaaacgagaagcggcgaagaaaaaacaagaaaggaaaaaaagagcaaaggaaaccctggaaaaaaagaagctacttaaagaactgtgggagtcaagtaaaaaggtccactgagaaaagaattagagattccaactgacagaatctgccagaagctcccagggaataatggtggcgagttccatcaccagcattattatagtgcttcaaaagaaatatttttgatgaacttaaaagacaacaaatttatttaaatggtgcactaaactgtagtgaacagagacatgcacgattcaagaataaaactcggctgggcacggtggacggtgcctcacatctgtaatcccagcactttgggaggccgaggcgggcggatcacttgaggtcaggagtttgagaccagcctggccaacatggtgaaaccccgtctctactaaaaatacaaaaaattagccaggcatggtggcgggcacctgtaatcccagctactcgggaggccgaggcaggagaattgcgtgaacctgggaggcggaggttgcagtgagctgagatcgcgccactgcactcaagcctgggcaacacctgggtgacagagcgagaccccatctcaaaaaaaaaataaaactagttcaagtgcaatgacacacgcctataatcccagcaccttgggaggctaagacaggaagatcacctgagcccaggagctcaagattgcagtgagctatgaacaccactgcactccacctgtccacttgttcttgtgtgacagaacaagaccctgtctctaaaaaataagataaaaccataaagaaacacagtcagtactatacaagaataatggctacttctagagggaaggagttgtcattgtgatgaggcacttggaggggttctggggtgcctgacaaagttctgtttcttcacctgggtggtagttagaagggtgtccccgtatttcaaattgtacctttgtgagattgtatgttttgtaataataaaattttttttgtaattagtaaa

SEQ ID NO: 5953 - DNA, 1326 bp, Homo sapiens
cttggaagatatttttggtctattgcaagaaaatatgtattagctggcagggcatgtcctggtaacatggcagacagtgcaaggctgaggagaggggcgtcttgctgaataatgtgtctctactcatttcctaaattccctcggtaacagatgggtcatcatttgaattgctttataaaaagctgtctttgaatctgaagcataatcttgagggcagatgcctcttactgaaagctctccttattcatctaacccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaaagtagatgttttctacaatggtgaaaacagtcctgttcacaaagaaaaacgagaagcggcgaagaaaaaacaagaaaggaaaaaaagagcaaaggaaaccctggaaaaaaagaagctacttaaagaactgtgggagtcaagtaaaaaggtccactgagaaaagaattagagattccaactgacagaatctgccagaagctcccagggaataatggtggcgagttccatcaccagcattattatagtgcttcaaaagaaatatttttgatgaacttaaaagacaacaaatttatttaaatggtgcactaaactgtagtgaacagagacatgcacgattcaagaataaaactcggctgggcacggtggacggtgcctcacatctgtaatcccagcactttgggaggccgaggcgggcggatcacttgaggtcaggagtttgagaccagcctggccaacatggtgaaaccccgtctctactaaaaatacaaaaaattagccaggcatggtggcgggcacctgtaatcccagctactcgggaggccgaggcaggagaattgcgtgaacctgggaggcggaggttgcagtgagctgagatcgcgccactgcactcaagcctgggcaacacctgggtgacagagcgagaccccatctcaaaaaaaaaataaaactagttcaagtgcaatgacacacgcctata

SEQ ID NO: 5954 - DNA, 604 bp, Homo sapiens
gattgcgaatcctccgctgaggtgatttggatatccctagaacgttgagggcacgagtcgggtcctgagaccaggtaagcatctgcggagaagccaggtaaccctacggctgccgacgactgtcaaaggctccggagagaggactgcgagccgggacgcctgggtttttcccgacttgcgaccccgagtggcgcagccagtttacctgaggccgcgctggcggtggggtggggccggccgtgacacccgagctcagttttctcgggacctggtttacgctaggtgctgtgggtcggccctggggctgttcaggcactcagggcaggggagaggagagactaccgtcctggagataacggttccacggaggcccaaggcgaaacggaaggatcctcatgtacaaaactgagcggaatggagctgtgagcacgcatcaggtgctgtttcaggcctggcacgtagtagaggtcctcagccagcagagccacgttccttatgagcaccgtgggtttatttcattttcctacaccactgacccgaatatgcccggcgccatggggactccggctttgggagaagctgacgttgttatccccaggaatag

SEQ ID NO: 5955 - DNA, 3733 bp, Homo sapiens
gctgaacataggaccccaatcccttctagcttgtagtgtttctcctgagaaatctgctgttaatctgataggttttcctttataggttacctggtgcttctgtctcacagactcttaaaattctttctttcattttaactttgtccggaattggtgggttcttggtcttgctgacttcaagaatgaagccacggaccctcatggtgagtattacagctcttaaagatggtgtgtccagagtttgttccttcagatgttcagatgcatccagagtttcttccttctggtgggtttgtggtctcgctgacttcaggagtgaacctgcagaccttcgcagtgagtgttgcagctcttaaaggcagcacagacccaaggagtgagcagcagtaacatttaccacaaagaccaaaagaacaaagcttccacagtgtggaaggtgacccgaacgggttgcactgctggctcaggcagcctgcgtttattcccttatctgaccccacccacatcctgctgattggtccattttacagagagctgattggcccattttacagacagctgattggtctgttttgacagggtgctgattggtgcgtttataaaccttgagctagacacagagtgctgactggtgcatttacaatcctttagctagacacaaaagttctccaagtccctagatttagctagacacagcactgattgatgtgtttacaaaccttcagctagacacagagtgctgattggtgcatttacaatcctttagctagacacaaaagttctccaagtccccactagattagctagacatagagcactgattggtgcatttacaaaccttgagctagacacagggtgctgattggtgtatttacaaaccttgagctagacacaaagtgctgactggtgtatttataaacctttagctagacataaaagttctccaagtccccacccgactcaggagtccagctagctttgcctactggatcccatgctggggccgtgggtggagctgcctgctagtcccacaccatgcccccgcactcctcagcccttgggcggtcaatgggactggttgcagagcagggggcggcgcccgtccgggaggctctggccatgagggagcagggcagggggagggggggactcaggcatggcgggttgcaagtcccacgccctgctccacggggaggcagctgaggcccagcgagaattcaagcacagcccgggtgagctggcagtgctgggggacccggcacaccctccacagctgctggccggggtgctaagcccctcactgcctggggccggcggcaccagccggccactcctaggtcggggcccgccaagccctcactggcccgcgagctctccctccacacctccccacaagcggagggagcccgctttggccttggccagtccagagaggggcttccacagtgcagcggcgggctgaagggctcctcaagcacagccagagtggatgccgaggccaaggaggcgccgagagcgagtgagggctactagcacattgtcacctctcatttggataacctgatgacaatatgcctagatgaagatctttttgcaatggatttctcaggtgttctttgtgcttctcgtatttggatgtctaggtctctagcaaggccggggaagttttcctcgattattcccccaaatatgttttccaagcttttagatttctcttcttcctcaggaacaccaattattcttaggtttggtcgtttaacacaatcccagacttcttggaggctttgttcatattttcttattcttttttgtctttgttggattgggttaatttgaagaccttgtcttcgagctctgaatttctttattctacttgttgaattctattgctgagactttccagagcattttgcatttctaaaaatgtgtccaaagtttcctgaattttttattgttttttctttaagctatctatttccctgagtgatttctcccttcacttcttgtatcattttttggatttccttacattgggcttcacctttctctggtccttccctgattaataactaacctcctgaattctttttcaggtaaatcaggtatttcttcttggtttggatccattgccagtgaactagtatgttttttggggggtgttgaagcgtcttgttttgtcatattaccagggtttgttcatttgggtaggctctgtcagagggaaggtctagggctgaaggctgttcagattcttttgtcccatggggtgttctcttcatgtagtactctgccccttttcctatggatgtggcttcctatgagccaaacttgcagtgattgttgtctctcttctgggtctagccacccagcgaatcttcccagttccaggctggtactggaggttatctgcagagtcctgtgatgtgaaccatctatgggtctctcagccatggctaccagtgcctgttcggtggaggtggcagagggtacaatggagctttggtgggttaatggtctattttttttgctggttggcctcctgccaggaggtggtcctttccagaaagcatcagctgtggtaatatggggaggaaccagcagtgggcggggccctagaactcccaagatttatttgccctttgtcttcctgccagggtgcatagggaaggaccatcaggtgggggtggagctaggcgtgtctgagctcagactctccttgggcgggtcttgctgcggctgctgtagggaatgtgggtgagattcccaggtcactggagtcgtgtacctaggagagttatggctgcctctgctgagtcatgcaggttgtcagggaagtgggggaaagctggcagtcacaggcctcacccagctcccacacaaacccaagggccggtcttactcccaccgtgttcccccacaactgccccgagtctgtttccaggcagagggtgagactggcttgaaaatttgccccaaggctgtgcccctcccagcagcgaaagaaaagggctgtagttcttcccccacctgtgaagtctgcatgctggattcgtgcagttgcccaagttctggccaggaggcttctcaccctgtttaaattgttacgaagttcgactagagaattcttctccctgtggagttttatcccttgctcctctggccaccctcccgatggatccctgtggtgccaggcaggaatgggccttctggggacccagcgagctcccacggcctttctgctgcttcctctacccctgtagttcgctctgctgagtctgacttagctccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaaagtagatgttttctacaatggtgaaaacagtcctgttcacaaagaaaaacgagaagcggcgaagaaaaaac

SEQ ID NO: 5956 - DNA, 573 bp, Homo sapiens
gcgaatcctccgctgaggtgatttggatatccctagaacgttgagggcacgagtcgggtcctgagaccaggtgctgtgggtcggccctggggctgttcaggcactcagggcaggggagaggagagactaccgtcctggagataacggttccacggaggcccaaggcgaaacggaaggatcctcatgtacaaaactgagcggaatggagctgtgagcacgcatcaggtgctgtttcaggcctggcacgtagtagaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaaggtagatca

SEQ ID NO: 5957 - DNA, 2633 bp, Homo sapiens
cgtcaccgccgcgcagcgcgggcgcagagccctgccctcagctgaagggagtcttcttttttttttttttttccgctgtttttttctccgcccctaagaggttgactccaaacccggagttccgctaggtccaacaggagggcttacggcgtgagcggcgtacctggggagaggcttaggcagcggcaaccgctgattggcagtaaaggggttcactccccatctcctgctcgggcgaaaccgggacagccaatcagagagagtactgacggaaacggcccaatcctggagcagggctgagggagggggcggggacaaatggctcaggtggactccgggctggagctgtcctgggggagcttgtttgcggcagcggctgctgctgccactgctgtgctgggggcccggtcgccaggcaaaaagccctcccacgtttgaggggagtcatgagccgtttcctgaatgtgttaagaagttggctggttatggtgtccatcatagccatggggaacacgctgcagagcttccgagaccacacttttctctatgaaaagctctacactggcaagccaaaccttgtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtctatggaactgcagctcccacgattggcgtcctggcacccctgatggtggcaagtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctctgctctgatcagttcttgtactttgacctctgctaagacaagagcatggctgcctcctctgagccctaggagaatcacagctttatgcctgattgaatacaccatagtgagtaggacagctcatgacacaggtcagcctggctgcctccggctccttactgtcatttgctcattcctcttgtattcttgaagtcaaatcttcttttttctcaccttcaagagtctgcgttcacaactaaacactaagtgccctttcttatttcctcctaaagaagaaacagattcttgagagagcagagacaaaaaaatagaactaggcagcatagatgaaacaactgcatgacatgggaagaagacaactaaaccccgaggagaatgcactggaatggacagttgctcttaaaccctacccagagggcctcccccagctggaccctcatacacagtgtgtgtatccaaaaggccattgctatttcagcaaatatttgttgagtacttctccatgccggacacttgggaaagagaaatgaacgacacaggcaatgcccctgccctgtgggccttatattatagtcaaggtaacagaatcaacaagccaacacaaaaataaagaacttcaaatagggataagaactctaacaaacacaaggtattttggtcaagaaggaatgtggggtgggcagtggggaacgtaacttaaattagatcatcagaaagtcctccctgaggagatgggatttttttgttttttagagacagggtttcactctgtcacccaggctggagtgcagtggcacaatcacacctcactgcagcctcaacttcctgggctcaagtgatcctcctgcatcagcttcccaagtagctgggactacaagtgtgtaccaccacatccagctaacatttttgggggtgggaagagatggggtcttactatgttgtccaggctaagaggtgggatttgagctgagacttgaatgcccaggagttaaatgtcttaagatatggagcaggccgttagaaaggagggagcagcaactggaaggtagaatagtcttattcaaggaataagaactatgtaatcacagcatggtgaagagttaggaagtg

SEQ ID NO: 5958 - DNA, 2722 bp, Homo sapiens
agaagggctggtccagcggcggcggaggctggcgctgtcctgagagggagggctctgtgcggaagagtcagggcgacccttgggcgctggagtacgcttgggactggggctgcgagtgagcaccagcgattggttcggaagcggacatttggttcagaacgagcatttaactctgccagggatccgctgggctctgacgactgcggtagatccatggcttcctggacgttcacccgtagagtcatcctagcttaactcttgttccctggtctcagttcacaagcctcacctgtatcttcctggctcggaagataattgaaaccaagtctgacttctcaatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcctacttctacctactccctgagcagcttttttagagctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttgggcccattacccatgggcagtgccagctactcttgacacagataacttcagactgatcttctgtccaaggaacatcatctgaggatcgagatctaaagctttgagtcatgagaatgattctctccacctggtgctcatatgaaggtgggagtgatttctagattgggcccctactgggtaagatctcacttggtctgagaaaagtgactgctccagaaaggaagaggtatgggagtcatagggtggctactgcattccactcagctaattatgatccaggacttggcgctggacattggcagttctgctctgaatgaagtcagaacagaaccaaaatggcctcaggaaggaatgccagtgtttcccaagacctcctggagatgcactcacaccagactgcacagacccctccacattatgccacacatggcctagacgttgtgtttcctcagccattttccctctgctgccccagtttactctgtccaaaaccctaaggttcttctctcacttgaacacagacgaccttgcttgggtgatgagacatcccctttatctcttcctctactgctggccaagacccgtcactttataagaagctcagatgcagcagtgctggagagctctctctttatgcaaaaatctcatttcaccaggagctttcagaagtttcacctgggctaaattcagcagcatttctgttaggatatttagatggaggttttattttcacacttggattcttgctctgtaccaatatttgcctccttttctgtgactgaactgggtttttctgacatgcctagactcctaataaaggtatttcttccttggtgccttc

SEQ ID NO: 5959 - DNA, 2761 bp, Homo sapiens
agaagggctggtccagcggcggcggaggctggcgctgtcctgagagggagggctctgtgcggaagagtcagggcgacccttgggcgctggagtacgcttgggactggggctgcgagtgagcaccagcgattggttcggaagcggacatttggttcagaacgagcatttaactctgccagggatccgctgggctctgacgactgcggtagatccatggcttcctggacgttcacccgtagagtcatcctagcttaactcttgttccctggtctcagttcacaagcctcacctgtatcttcctggctcggaagataattgaaaccaagtctgacttctcaatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcctacttctacctactccctgagcagcttttttagaggtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttgggcccattacccatgggcagtgccagctactcttgacacagataacttcagactgatcttctgtccaaggaacatcatctgaggatcgagatctaaagctttgagtcatgagaatgattctctccacctggtgctcatatgaaggtgggagtgatttctagattgggcccctactgggtaagatctcacttggtctgagaaaagtgactgctccagaaaggaagaggtatgggagtcatagggtggctactgcattccactcagctaattatgatccaggacttggcgctggacattggcagttctgctctgaatgaagtcagaacagaaccaaaatggcctcaggaaggaatgccagtgtttcccaagacctcctggagatgcactcacaccagactgcacagacccctccacattatgccacacatggcctagacgttgtgtttcctcagccattttccctctgctgccccagtttactctgtccaaaaccctaaggttcttctctcacttgaacacagacgaccttgcttgggtgatgagacatcccctttatctcttcctctactgctggccaagacccgtcactttataagaagctcagatgcagcagtgctggagagctctctctttatgcaaaaatctcatttcaccaggagctttcagaagtttcacctgggctaaattcagcagcatttctgttaggatatttagatggaggttttattttcacacttggattcttgctctgtaccaatatttgcctccttttctgtgactgaactgggtttttctgacatgcctagactcctaataaaggtatttcttccttggtgccttc

SEQ ID NO: 5960 - DNA, 1623 bp, Homo sapiens
cttctctaagctgcacagcctgaatagaagggctggtccagcggcggcggaggctggcgctgtcctgagagggagggctctgtgcggaagagatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttgggcccattacccatgggcagtgccagctactcttgacacagataacttcagactgatcttctgtccaaggaacatcatctgaggatcgagatctaa

SEQ ID NO: 5961 - DNA, 2934 bp, Homo sapiens
gattattcccttccgcccccttctctaagctgcacagcctgaatagaagggctggtccagcggcggcggaggctggcgctgtcctgagagggagggctctgtgcggaagaggtgagggtgtcccaagccccttgggtcgcgtatctggctggatccagcctctccgcatcttgatcttttcccctcttctaggaggcatccctacaccctatgactacaggcctgattctcttctttcagtcagggcgacccttgggcgctggagtacgcttgggactggggctgcgagtgagcaccagcgattggttcggaagcggacatttggttcagaacgagcatttaactctgccagggatccgctgggctctgacgactgcggtagatccatggcttcctggacgttcacccgtagagtcatcctagcttaactcttgttccctggtctcagttcacaagcctcacctgtatcttcctggctcggaagataattgaaaccaagtctgacttctcaatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcctacttctacctactccctgagcagcttttttagaggtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttgggcccattacccatgggcagtgccagctactcttgacacagataacttcagactgatcttctgtccaaggaacatcatctgaggatcgagatctaaagctttgagtcatgagaatgattctctccacctggtgctcatatgaaggtgggagtgatttctagattgggcccctactgggtaagatctcacttggtctgagaaaagtgactgctccagaaaggaagaggtatgggagtcatagggtggctactgcattccactcagctaattatgatccaggacttggcgctggacattggcagttctgctctgaatgaagtcagaacagaaccaaaatggcctcaggaaggaatgccagtgtttcccaagacctcctggagatgcactcacaccagactgcacagacccctccacattatgccacacatggcctagacgttgtgtttcctcagccattttccctctgctgccccagtttactctgtccaaaaccctaaggttcttctctcacttgaacacagacgaccttgcttgggtgatgagacatcccctttatctcttcctctactgctggccaagacccgtcactttataagaagctcagatgcagcagtgctggagagctctctctttatgcaaaaatctcatttcaccaggagctttcagaagtttcacctgggctaaattcagcagcatttctgttaggatatttagatggaggttttattttcacacttggattcttgctctgtaccaatatttgcctccttttctgtgactgaactgggtttttctgacatgcctagactcctaataaaggtatttcttccttggtgccttc

SEQ ID NO: 5962 - DNA, 1832 bp, Homo sapiens
gaatagaagggctggtccagcggcggcggaggctggcgctgtcctgagagggagggctctgtgcggaagaggtgagggtgtcccaagccccttgggtcgcgtatctggctggatccagcctctccgcatcttgatcttttcccctcttctaggaggcatccctacaccctatgactacaggcctgattctcttctttcagtcagggcgacccttgggcgctggagtacgcttgggactggggctgcgaatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcctacttctacctactccctgagcagcttttttagaggtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttggg

SEQ ID NO: 5963 - DNA, 533 bp, Homo sapiens
acagcctgaatagaagggctggtccagcggcggcggaggctggcgctgtcctgagagggagggctctgtgcggaagaggaggcatccctacaccctatgactacaggcctgattctcttctttcagtcagggcgacccttgggcgctggagtacgcttgggactggggctgcgagtgagcaccagcgattggttcggaagcggacatttggttcagaacgagcatttaactctgccagggatccgctgggctctgacgactgcggtagatccatggcttcctggacgttcacccgtagagtcatcctagcttaactcttgttccctggtctcagttcacaagcctcacctgtatcttcctggctcggaagataattgaaaccaagtctgacttctcaatgaatcggacaaagggtgatgaggaggagtattggaacagctccaagttcaaggcttttacctttgacgatgaagacgatgagctttcacagttaaaggagtccaagcgggcggtgaacagcctccgagacttcg

SEQ ID NO: 5964 - DNA, 2562 bp, Homo sapiens
gcggtctcgttattcgtgttttctctccgccctacgattattcccttccgcccccttctctaagctgcacagcctgaatagaagggctggtccagcggcggcggaggctggcgctgtcctgagagggagggctctgtgcggaagagatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcctacttctacctactccctgagcagcttttttagaggtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttgggcccattacccatgggcagtgccagctactcttgacacagataacttcagactgatcttctgtccaaggaacatcatctgaggatcgagatctaaagctttgagtcatgagaatgattctctccacctggtgctcatatgaaggtgggagtgatttctagattgggcccctactgggtaagatctcacttggtctgagaaaagtgactgctccagaaaggaagaggtatgggagtcatagggtggctactgcattccactcagctaattatgatccaggacttggcgctggacattggcagttctgctctgaatgaagtcagaacagaaccaaaatggcctcaggaaggaatgccagtgtttcccaagacctcctggagatgcactcacaccagactgcacagacccctccacattatgccacacatggcctagacgttgtgtttcctcagccattttccctctgctgccccagtttactctgtccaaaaccctaaggttcttctctcacttgaacacagacgaccttgcttgggtgatgagacatcccctttatctcttcctctactgctggccaagacccgtcactttataagaagctcagatgcagcagtgctggagagctctctctttatgcaaaaatctcatttcaccaggagctttcagaagtttcacctgggctaaattcagcagcatttctgttaggatatttagatggaggttttattttcacacttggattcttgctctgtaccaatatttgcctccttttctgtgactgaactgggtttttctgacatgcctagactcctaataaaggtatttcttccttgg

SEQ ID NO: 5965 - DNA, 1080 bp, Homo sapiens
gcggccaccgcttttaagccacgattggcgaaggccgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaagatgaaacagaatttagaaacttcatcgtttggcttgaagaccagaaaatcaggcactacaagattgaagacagagggaatttaagaaacatccacagcagcgactggcccaagttctttgaaaagtatctcagagatgttaactgtcctttcaagattcaagatcgacaagaagctattgactggcttcttggtttagctgttagacttgaatatggagataatgctgaaaaatacaaggatttagtacctgataattcaaaaactgctgacaatgcaactaaaaatgcagaaccattgatcaatttggatgtaaataatcctgattttaaggctggtgtgatggctttggctaacctgcttcagattcagcgtcatgatgattacctggtaatgcttaaggcaattcggattttggttcaggagcgcctgacacaggatgcagttgctaaggcaaatcaaacaaaagagggcttacctgttgctttagacaaacatattcttggttttgacacaggagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttctttaataaagtttaggaaagtagaa

SEQ ID NO: 5966 - DNA, 643 bp, Homo sapiens
atcccctgcgcgcgcctgcgcgctcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaacttgatcctgctactta

SEQ ID NO: 5967 - DNA, 842 bp, Homo sapiens
ggtgcgttctgagccgtctgtcctgcgccaagggagcgtaccttggccttgagaggttcagctgcctaacccagaggctacgcagagttagagaagccagagtccaagccaagaactctgactccacatccagtcccttctctcctttataactcaagtttccttgcgccacactgccctccacgttatgctgtacatgacaacttgggtgaggcaacagggaagctgaaaagagatcatacggtgctgaatgaaattgtatggaactcgcgggtcagacatttcccatttccagtgtcagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaactt

SEQ ID NO: 5968 - DNA, 707 bp, Homo sapiens
agggtgagcctttctaggacctcaggggaagcttgagcgccgcggctggcccgggagtctgtttcacgggagttccgtggcaacccctgtgtgtacaagaaaatgccctccggtcactccctggcctctctatttagaggctgctgcctcggagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaacttgatcctgctact

SEQ ID NO: 5969 - DNA, 472 bp, Homo sapiens
tctgagccgtctgtcctgcgccaagggctgttcgtttcttggaacctcacactgtcagagcattcgagtagcttgaggacaggaaatttgagggcggactatctgcaaggtgttccaggagaaggacacagtcgcatcctgcaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgca

SEQ ID NO: 5970 - DNA, 3275 bp, Homo sapiens
gcccctgcaggtgccatgactcagcagccccaggacgactttgacaggagcgtggaggatgcccaggcatggatgaaggctgtgcaggaccagctgcaggtcaatgacaacacgcagggaccccgcgcggccctggaggccaggctgtgggagaccgagaaaatatgccagctggagcccgaggggcgtgtgagggtggacctcgtgctacggatggctgaagccctcttggcatgctgccctggggaccagaagcccgggatcctggcccggctgaaggacatcaaggcccaatgggaggagacagtcacctacatgactcactgtcacagccgcatcgagtgggtgtggctgcactggagcgagtacctgctggcccgagatgagttctaccgctggttccagaagatgatggtcacactggagccccacatcgagctccagctgggcctgaaggagaagcagtggcagctgagccacgcccaggtgctgctgcacaacgtggacaaccaggcggtgctcctggaccggctgctggaggaggcagcctccctgttcaacaggatcggggaccccagcgtggacgaagatgcccagaagagaatgaaggctgagtacgatgcagtgaaggccaaggcccagaagcgtgtagatctgctggagcaggtggcccgggagcatgaggagtaccaggcaggtgtggacgagttccaactgtggctgaaggcggtggtggagaaggtgaatggctgcctggggcggaactgcaagctgcccatcacgcagcgcctctccacactgcaggacattgccaaagattttcccaggggcgaggagtctctggagacgctggaggagcagtctgcgggtgtcattcggaacacctctcctttgggtgcagagaagatcaccggagaactggaagagatgaggaaagttctggagaagctgcgcgccctctgggaggaggaggaggagcggctgcggggcctgctccggtccaggggagcctgggagcagcagattaagcagctggaggctgagctcagtgagttcaggatggtcctgcagaggctggcccaggagggcctgcagcctgcggcgaaagcggggaccgaggacgagctggtggcacactggagacgctactcggcaacacgggcggcgctggcctcggaggagccccgggtggaccggctgcaagcccagctgaaggagctcatcgtcttccctcacaacctgaagccactctctgatagtgtcatcgctaccatccaggagtatcagagcctgaaggtgaagagcgcgaggctgcgcaatgccgcggcggtggagctgtggcagcatttccagcggcctctgcaggatctgcagctgtggaaggccctggcccagcggctcttggaggtcactgccagcctgccggacctgccttcccttcacaccttcctgccccagatcgaggcagccctgatggaaagctcccgcctgaaagagctgctgacgatgctgcagctgaagaaagacctcctgattggcatctttggccaggagagagccacggcactcctggagcaggtggcaggttccatgagggacagagacctgctgcataacagcctcctgcagaggaaaagcaaactgcagagcctgctcgctcagcacaaagactttggagcagcttttgagcccctgcagaggaagctcttggacctccaggtcagggtccaagccgagaaggggcttcagcgggaccttcctggaaaacaggcccagctctcaaggttgcaggggctgcaggaagaggggctggacttgggggcacagatggaggctgcaaggcctctggtccaggagaaccccaaccaccagcacaaaatggaccagctttcctccgacttccaggccctgcagaggtctctggaggaccttgtggacaggtgtcggcagagtgtgcaggagcactgcaccttcagccaccagctgctggagctgcggcagtggatcgttgtgaccacgcaaaagctggaggcacaccggggagaggcgggcccgggggatgccgagtcccaagaggccgagtttgagaggctggtggcagaattcccggagaaggaggcccagctgtccctggtggaagcgcagggctggctggtgatggagaagtcttctccggagggtgctgccgtggtgcaggaggagctcagggagctggcagagtcgtggcgggccttgaggctgctggaagaaagtctgctgagcctcatcagaaactggcatctgcagaggatggaagtggattcggggaagaaaatggttttcaccaacaacatcccaaagtcaggatttctcatcaatcccatggatcctattcccaggcatcgtcgacgcgcaaatcttctacaggaagaagaagggagccatgaagatttctcccagctcctgaggaactttgggcagtggttgcaggtggaaaactccaagctggttagaatcatcgcaatgagaacttctacagctgaggacttgaggaccagaaaatcgaagctgcaggagctggaggctcgggtgccagaaggtcagcatctctttgagaacctccttcgtctcgggccagcaagggggacctcggatgagctggaagatctgcgctaccagtggatgctgtacaagtccaagctgaaggactctggccacctgctgacacaaagttctccaggggagccgactggattccaaaagactcggcggtggcgaggactgggctccctcttccggagggcgtgctgtgtggcgctcccactgcagctgcttctgctgctgttcctcctcctgctgttcctgctcccaatcagggaagaggaccgcagctgcaccctggccaacaacttcgcccgctccttcacgctcatgctgcgctacaatggcccaccacccacctaacccactggggcacacaggtgactttctcctccaacctccatcagtcccagggcccctcctgaggatgctcgccagggaaactggaaacaggggcagggcaaagactgcagagctgcatccatatcagtgctgtgtcagcgttcccagaagacacttactttttatacagtgttgtcttagtctatttatactaaatgtgtactacatgtgactagggaataatgtctagaatttttatatgatctgtatgtaaatgctcagtatgtataatttcatatacgagttctatttggagttgggaaaattcctagcaatggctccctccaatggga

SEQ ID NO: 5971 - DNA, 2615 bp, Homo sapiens
gcccctgcaggtgccatgactcagcagccccaggacgactttgacaggagcgtggaggatgcccaggcatggatgaaggctgtgcaggaccagctgcaggtcaatgacaacacgcagggaccccgcgcggccctggaggccaggctgtgggagaccgagaaaatatgccagctggagcccgaggggcgtgtgagggtggacctcgtgctacggatggctgaagccctcttggcatgctgccctggggaccagaagcccgggatcctggcccggctgaaggacatcaaggcccaatgggaggagacagtcacctacatgactcactgtcacagccgcatcgagtgggtgtggctgcactggagcgagtacctgctggcccgagatgagttctaccgctggttccagaagatgatggtcacactggagccccacatcgagctccagctgggcctgaaggagaagcagtggcagctgagccacgcccaggtgctgctgcacaacgtggacaaccaggcggtgctcctggaccggctgctggaggaggcagcctccctgttcaacaggatcggggaccccagcgtggacgaagatgcccagaagagaatgaaggctgagtacgatgcagtgaaggccaaggcccagaagcgtgtagatctgctggagcaggtggcccgggagcatgaggagtaccaggcaggtgtggacgagttccaactgtggctgaaggcggtggtggagaaggtgaatggctgcctggggcggaactgcaagctgcccatcacgcagcgcctctccacactgcaggacattgccaaagattttcccaggggcgaggagtctctggagacgctggaggagcagtctgcgggtgtcattcggaacacctctcctttgggtgcagagaagatcaccggagaactggaagagatgaggaaagttctggagaagctgcgcgccctctgggaggaggaggaggagcggctgcggggcctgctccggtccaggggagcctgggagcagcagattaagcagctggaggctgagctcagtgagttcaggatggtcctgcagaggctggcccaggagggcctgcagcctgcggcgaaagcggggaccgaggacgagctggtggcacactggagacgctactcggcaacacgggcggcgctggcctcggaggagccccgggtggaccggctgcaagcccagctgaaggagctcatcgtcttccctcacaacctgaagccactctctgatagtgtcatcgctaccatccaggagtatcagagcctgaaggtgaagagcgcgaggctgcgcaatgccgcggcggtggagctgtggcagcatttccagcggcctctgcaggatctgcagctgtggaaggccctggcccagcggctcttggaggtcactgccagcctgccggacctgccttcccttcacaccttcctgccccagatcgaggcagccctgatggaaagctcccgcctgaaagagctgctgacgatgctgcagctgaagaaagacctcctgattggcatctttggccaggagagagccacggcactcctggagcaggtggcaggttccatgagggacagagacctgctgcataacagcctcctgcagaggaaaagcaaactgcagagcctgctcgctcagcacaaagactttggagcagcttttgagcccctgcagaggaagctcttggacctccaggtcagggtccaagccgagaaggggcttcagcgggaccttcctggaaaacaggcccagctctcaaggttgcaggtgaggggtctgtgaggcctgaatcactcctgcccaggtgctcagctgcacctggaagcagcgtctccctctagcagtaaccagcaaagcaacagctgccgtgagccagaaatttagacccttagttgagatctgacctttcacctcaacagaacctctgcttatttatctgatggttcctgacctcaaacaactgagtcttgagctcagcaaaatgacaaactgtctttctgtttactcctcagttccaaagtctaacattggtatttgtttttagaattgctttgctaagtattcttaatgagtccagaggtgttcagttaaaccaactttgggattaagaataaatgttctgaaacgtggactgtaagtaggctgaccgttgatcattgttggctggataaggaacttgatggttttttaaaatgcgcgtgatacaatagttctctctttaaaacccaagcacagctcatacataaattgagagtgttctctagaagacattaaaaatagtgcattttaggccgggagcggtggctcacgcctgtaatcccagcactttgggaggtgagcagattgcctgactttaggattttgagatcagcctgggcaacatggtgaaaccctgtctctacttaaaataaaaaattttttttaaaaaagcaaaaaatttagccaggcgtggtggcgggaatctgtaaccccagctacttgggaggccgaggcaccagaatcacttgaacccaggaggcagaggttgcagtgagcccacattgtgccactgtgctccagcctgggcgacagagtgagactctgtctccaaa

SEQ ID NO: 5972 - DNA, 3138 bp, Homo sapiens
gcccctgcaggtgccatgactcagcagccccaggacgactttgacaggagcgtggaggatgcccaggcatggatgaaggctgtgcaggaccagctgcaggtcaatgacaacacgcagggaccccgcgcggccctggaggccaggctgtgggagaccgagaaaatatgccagctggagcccgaggggcgtgtgagggtggacctcgtgctacggatggctgaagccctcttggcatgctgccctggggaccagaagcccgggatcctggcccggctgaaggacatcaaggcccaatgggaggagacagtcacctacatgactcactgtcacagccgcatcgagtgggtgtggctgcactggagcgagtacctgctggcccgagatgagttctaccgctggttccagaagatgatggtcacactggagccccacatcgagctccagctgggcctgaaggagaagcagtggcagctgagccacgcccaggtgctgctgcacaacgtggacaaccaggcggtgctcctggaccggctgctggaggaggcagcctccctgttcaacaggatcggggaccccagcgtggacgaagatgcccagaagagaatgaaggctgagtacgatgcagtgaaggccaaggcccagaagcgtgtagatctgctggagcaggtggcccgggagcatgaggagtaccaggcaggtgtggacgagttccaactgtggctgaaggcggtggtggagaaggtgaatggctgcctggggcggaactgcaagctgcccatcacgcagcgcctctccacactgcaggacattgccaaagattttcccaggggcgaggagtctctggagacgctggaggagcagtctgcgggtgtcattcggaacacctctcctttgggtgcagagaagatcaccggagaactggaagagatgaggaaagttctggagaagctgcgcgccctctgggaggaggaggaggagcggctgcggggcctgctccggtccaggggagcctgggagcagcagattaagcagctggaggctgagctcagtgagttcaggatggtcctgcagaggctggcccaggagggcctgcagcctgcggcgaaagcggggaccgaggacgagctggtggcacactggagacgctactcggcaacacgggcggcgctggcctcggaggagccccgggtggaccggctgcaagcccagctgaaggagctcatcgtcttccctcacaacctgaagccactctctgatagtgtcatcgctaccatccaggagtatcagagcctgaaggtgaagagcgcgaggctgcgcaatgccgcggcggtggagctgtggcagcatttccagcggcctctgcaggatctgcagctgtggaaggccctggcccagcggctcttggaggtcactgccagcctgccggacctgccttcccttcacaccttcctgccccagatcgaggcagccctgatggaaagctcccgcctgaaagagctgctgacgatgctgcagctgaagaaagacctcctgattggcatctttggccaggagagagccacggcactcctggagcaggtggcaggttccatgagggacagagacctgctgcataacagcctcctgcagaggaaaagcaaactgcagagcctgctcgctcagcacaaagactttggagcagcttttgagcccctgcagaggaagctcttggacctccaggtcagggtccaagccgagaaggggcttcagcgggaccttcctggaaaacaggcccagctctcaaggttgcaggggctgcaggaagaggggctggacttgggggcacagatggaggctgcaaggcctctggtccaggagaaccccaaccaccagcacaaaatggaccagctttcctccgacttccaggccctgcagaggtctctggaggaccttgtggacaggtgtcggcagagtgtgcaggagcactgcaccttcagccaccagctgctggagctgcggcagtggatcgttgtgaccacgcaaaagctggaggcacaccggggagaggcgggcccgggggatgccgagtcccaagaggccgagtttgagaggctggtggcagaattcccggagaaggaggcccagctgtccctggtggaagcgcagggctggctggtgatggagaagtcttctccggagggtgctgccgtggtgcaggaggagctcagggagctggcagagtcgtggcgggccttgaggctgctggaagaaagtctgctgagcctcatcagaaactggcatctgcagaggatggaagtggattcggggaagaaaatggttttcaccaacaacatcccaaagtcaggatttctcatcaatcccatggatcctattcccaggcatcgtcgacgcgaagaagaagggagccatgaagatttctcccagctcctgaggaactttgggcagtggttgcaggtggaaaactccaagctggttagaatcatcgcaatgagaacttctacagctgaggacttgaggaccagaaaatcgaagctgcaggagctggaggctcgggtgccagaaggtcagcatctctttgagaacctccttcgtctcgggccagcaagggggacctcggatgagctggaagatctgcgctaccagtggatgctgtacaagtccaagctgaaggactctggccacctgctgacacaaagttctccaggggagccgactggattccaaaagactcggcggtggcgaggactgggctccctcttccggagggcgtgctgtgtggcgctcccactgcagctgcttctgctgctgttcctcctcctgctgttcctgctcccaatcagggaagaggaccgcagctgcaccctggccaacaacttcgcccgctccttcacgctcatgctgcgctacaatggcccaccacccacctaacccactggggcacacaggtgactttctcctccaacctccatcagtcccagggcccctcctgaggatgctcgccagggaaactggaaacaggggcagggcaaagactgcagagctgcatccatatcagtgctgtgtcagcgttcccagaagacacttactttttatacagtgttgtcttagtctatttatactaaatgtgtactacatgtg

SEQ ID NO: 5973 - DNA, 8053 bp, Homo sapiens
aaggtcctagaggaggctggcaggatataggttgtcctgtgcttaacttgaagcagatgtgccctctgtgaaccggggaatggggacggccgacacagggccactgcgtgcaacagcgccgggccagggctaaggaacaggcagagccggcgcccaggtgacaagagctctggcgatgggcccgcaggccccagcagttccctcatagaggccacgcggtgcaacacctgccaccggcagcggggcttccgggggtcctggggcagctggggccgacggggcgtcgccctttgccctctgacccctgccttttgcgcccccgctggcgctccctggttctgtgaggaacctcgcggcggcgtcgcaggcgtagagccagtcagtttgtgcttggtcgccagaggaggcggtggctgaggagagttgagtccactgctgaccctgttttacggtaggaggcacggctagctctaaatgggcaatttacttagtaaatttagacccgggtgccgccgccggcccctgccagggccagggcgtggcgcccccgctcccctgtcccgggacgcctccccgcccggtcgggctcactctgtacccaccccgcgccctttccgcggcctgttccgccggaacgcccgtcgcaggccttcagcagccagcatcttcgtcgcccctaagaggccgtgtcctctccctcgggctgcggccgcccctctgggggtcctgccggctgtgggttgggggctggccatcaggaagacacccatgctgcctgctcggaaccccccgaggtttggacaccccagttccgtaaggatccctcctcccagccgcatgttcactctcctgctgccttcaccacgtgagccggcggtcaaggccaggaagcccatcccagccactctcctggaggagaccgaggtgtgggcccaagaagggcccagaagagtgaagaaggatgaggatccggtgcagatcgaaggggaggatgacgagaaaaggaccccccttagcagcggagaagcatcgtccacatccaggtcccagggcacccagggagacgtggcctccttcagatgcagccctgggcctctggagggaaatgtctaccacaagttctcagaaaacagcatgagtgagaaggcccaggcgtctccagcgagctcctgcttggaaggccctgccatgcccagcacacacagccaggccggatgtgcccggcatcttggaaagcctgatccggatgcaacagcgccccctgagccagccgttggctgctccctgctgcagcagaagttggctgcggaagtgctgaatgaagagccaccgcccagctccctaggcttgccgattccgctgatgtccggaaagaggatgcctgatgagaagcctttctgtattcctccaaggagcgctgctcctcccagagctgcccgcaacaggccctgcaaaaggaaaatgtcgattccattgctgctgccgctgcccccttcactgccattgctgtgggatcgaggtgagcttcccccacctgctaagctcccctgcctgtctgttgagggagacctacacaccttggagaagagccctgagtataaaaggaatagcagaatcttggaggataaaacagagaccatgacaaacagcagcatcacccagcctgccccttctttctcccaacctgtgcagaccacagactccctgcccctgaccacttacacttcccaggtctcagctcctttgcccatccctgacttggctgacctggctactggacccctcatcctgcctatccctccactttccaccacaccaaaaatggatgagaaaatagcattcacaatccctaactctcctctggctcttcctgctgaccttgttcccattttgggtgatcagtctaatgagaaaggaggctcttataattcagtcgtaggagcagcgcctctcacttctgaccccccaacacctcctagctccacaccctccttcaagcctcccgtcacaagggagtccccaatatctatgtgtgtggattcccctcctcctctttccttcctgactcttcttccagtcccttccaccgggacctcagttatcaccagcaagcctatgaattccacgtcagtcatttccactgtcacaacaaacgcatctgcccacctaacctcacagactgcggtagaccctgaagtagttaatatggatactactgccccatctcaggttgttattttcacatcttccctaagctccagagtgagctctctcccaaattcccaaatacattgcagtgcagagcagaggcacccgggaaagacatcagtctacacatccccacttccatttatattccacaataccaccccaagttttaaccaactctttggaaaagaagccacccctcagcccaaatttgaggctcctgatgggcagccgcagaaagcttctctccccagtgcctgtgttttcctgagccttcccatcattcctcctccagacacctccactttagtgaacagtgcctctacagcatcatcatccaaacctcccattgaaaccaatgctatgcataccactcctccttccaaggctgtcatcttgcagtctgcctctgtctccaagaagtacctcccattttacctggggcttcctggttctgggaacacacaacccagcggcaacactgcctcagtccaaggctccaccagtttgcctgcacagtcagtcagggcaccagctacagcttccaaccatcctttaaatccaggagccacccctcaacccaaatttggggcccctgatgggccgcagcagaaaacctctctccccagtgcccatgatttcctgagccttcctatcatggttcctccagacacctccactttagtgagcagtgcctctgcagcatcgttatccaagcctgccattgacaccagtgacatgaataccacccctccttccaaaactgtcatcttgcagtctacctttgtctccaggaaggaggagtacatccgattttatatggggcttcctggttctgggaacacactacacagtgacagcattgcctcagcccaagtctccaccagttttcctgcacaggcagataggagaccaaccacaacttccagccatcctttaaatacaggatccatctctcattccacacttggggccactgatgggcagcagaagtctgacagttcttttattctggggaatccagcaaccccagcaccagttataggcttaacatctccttcagtccagccactgagtggcagcataattccaccaggttttgcagagttaacatcaccatatactgcattgggcacacctgttaatgctgagccagtcgagggtcacaatgcaagtgctttccccaatggcacagcaaagacttctggatttagaattgccactgggatgcctggcactggagacagtaccttactggttggaaatactattccaggcccacaagtgattatgggacctggaacccctatggatggtgggagcattgggttcagcatgtctgccccaggccccagttccacatcaggagaactcaacattggacaaggacagagtgggacacccagcaccacttctgttttcccatttggtcaggcagcctgggacccaactggccacagcatggctgctgcaccacaaggggctagcaacattcctgtatttggatatacttctgctgccgcctacattcctggtttagacccacctacccagaattcatgcagtggtatgggaggggatggcaccagatccatagttggaggcccttgtgttcctgcttttcaacagtgcatcctgcagcacacatggacagagagaaaattctacacttcaagcacccactactatggacaagaaacatatgttaggagacatgtctgtttccaacttccgtaagagcacctgtggttcacctgatcacaccacatcagttgtggttgtaaataccagcattatccttttgtatggtcatgcttctagtttcatcttcatgccaagcacctgccatgtacctctccagaactcaggttgtgcaccaggaggggacaacaacatccctgtgctccctttctctgtcagtacacatgggtcccacctggacaaaacacaggtggtgcatctgcagtgaatggcaacatatctttaattagaggcccttgtgtatccacctaccaacaaagtacctagggcccacctggacaaaacacagatggtacctcttccaggagtgtcaacattcatttgatagaaggccctcatgtgcccatgtatcagcaaagcacctggggcccacctggacaaagcacaaaccatgcaatgagggacagcaacacaacggctgtgactggttgtacttttggtcccccatttacacaaagcacctgaggcccacctggctaaatgcaggtggtgcaataggagatagccccagatatttgtagggagaaacctctagtctccctttcagtaaaaatactatggacctgcccaaccaaggtgctccttttgactttagaggaaccagcattgtttttgttttggtttgtttgtttgtttgtttgtttgtttgtttgtttttgagacggagccttagcccaggctggagtgtagtagcacaatctcggctcactgcaacctccacctcctgggttcaagcaattctcctgtcttagcctcctgagtagctgggactacaggcatatgccaccacacctggctattttttataattttagcagagacagagttccaccttattggccaggctggtctcaaactcctgacctcaggtgatccacccacctcggcctcccaaagtgctaggatgacaggtgtgagccaccatgcccagcctagaggagccagcattgttagttaaatacttgtgtttggatggtcctggtcagagcacctgtgcctgtgatggaaagcagccactagtgacacttgtacctgccaaggccttcataggagccaccaactcattttttactcctatcaatggtcttaagaaataagcactctccctgcacatacagttctcataaattgacattgttccaggaggaatgggctcagttccctcaaggttaaacttaacctgctctcttcctacagaagctggaggcccaaaaccacagacagagagagagagagtgtgtgtgtttgtgtgtgtgtgtgtgtgtttattggtgagtgtggagcagatgagcccagtcagaaccgcactgtattttagtggtcttctgcactgtggagggtagaggaaacctggcttgactgttaacttggctgaccctacctctgggccagttctctctagtcatggacagaaaggcaaaattcccgactttgtggaccctatattctagttgaaggggagaaaagaagcaaaaacatggaaattatctggtaaattagccagtaacgaatgctatgaaaaataaagaagtacatggaggattgagattgtagatagaagcaggtgtttcagtttacactgtgaacaagcctcactgggaaggtaaatttaaacgaagcctagagagaagcagttgagccagatatatgagcaaagacctttccagataataggagtggtcattgcagaggctcaaaggaaggatccctggtgtcctcatggagcagttagtaaggaaatgtggctggaatggagtcagcaagtgggagggagggatagagaagaggacagaggagagatgtgagtggaattccttcctccactttttactaattgtgtaataacagttgactcaaacttcaaaagtctcaatgaaatcagtacttttactatggcctgtttatctcataagatttttgaaaggataaaatgaaataatatggagaaatgacttataagcttttgttgtaatttgttatatacatagggatggatagacggatggatagattagatgatagatagatagatagatagatgataacgttatggactgaatgtttgtgtacccccaaaaattgatattttgaagcctaacttccagtgtgatggtattaggaggtgaggctttggggaggtgattaggtttagatgaagtcatgaaaatgaaacccccatgatgggatttgcgcctttatgagaagaaataccagtgctttctctaattgccatgtgaaggtataccaacaaggtaacagtctgtaagccaggaaaagagtcctcacaagaaacagaatttgtctttatcttggacttcctaacctttagaattgtagaaaataattgaatgttgtttaagctaccagtctgtggcattttttgtagcaatcagaactgactaataaagatagatagatgatagatagatacatagatagatgatagagatagatgatagatagatagatagatagatagataatatacatatatatgtatggtcaatgactgagttccttaggcaatggtgccctgattgcctttattaggcaattcaaatagaagaatagaagaacccccttttttttttgagatggagtcttgctctgtcacccaggctggagtgcagtggcgtgatcttggctcactgcacgctccacctctcggaagaacccctttttattagcataaaagcacttacttttatgaagcaaacacatgtaaaaatatgataacagagactaaaacatttatgagattaggcctgaaagaaaacaatcacagagaaattactgaattcctcttggcaccctggggcctgattcattcgctctaaattgtttagtacagttccagaggatcaaagctcctgtttcctggccagataatcacctaacttttgtaatcagaactgcctttcagaagtagagtggaaatccagttttcttctaatagccctatacccttgcagtattaccagggacaaattttttaaaattcatacttcttgacattttttaaaaggcttcaagctaaatattatgatcctggtaagacaaactttgaataaatgtgtgagagatacaaagataatttttgttttcatgttttgatgcacttacacaactgaaactatttctaaatattcttttattttttattaagataaaaagcaaacataatatcaatttaaataatactgaaagtcaaccttcctaccacagttccctcctccagagatagtgtttagctactttgatgtcactcccatagttctgagtttgcttttttacttcaactattatgttatcttacagatgtcattgtttttcctaaaacttgaagtgccttcctttttttctccttgaactcttttcccataaaaaaaaaatgtttttggtttctagaattttcaaatagtattgtttacttgactgaatcccttccttttccagaaaccttgagcctcctccactggtttgggagtggtaagaccaaagtaaatgtaaaaagtaaagtagaggttcctcttcaaagactttcctccctatctaattagaaataagtagtaacttcttttagaagcaaaatgtattcacagacctgtactaacattcttaaatatctgctagtcataataaagaaatcaatgtactttatgttcttagctcccacaatttagcctaagtatttgccctggcatgcttatactggtccaagcattaggtcatagcctgttcctcttccttatttagaagtgtttttacctttctcagcattccacaagttacttcctcattcctttgttctcctctacctttgcctcttttaaaagttctaaattgctagccaatcgggacaaatacagaatgtgaggtcctgttccagccaatggaaaccggacacagcagtagggtggacgcgtcaggttataaatgaccctgtctcctttgttcggtgtactcttgtggcaaaactgctggcaagtgtaccctttctgcaggaagtaaaaatggccttactaaataaatttatgttcaagtgctatttctttacgacaccgaggaacaagcatttcaaaca

SEQ ID NO: 5974 - DNA, 6771 bp, Homo sapiens
gggtcccaaaggaaagcagtgagtggtgctgtttccctgaaggaagggactaagggacggtggcgcgggcccggaccggggccccggggcggcggcacggccgatatggcatgctgtcacaaagtaatgctgctgctggacaccgcgggcggcgccgcccgccacagccgggtccggcgggccgccctgcgcctcctcacctatctgagttgccgattcggcctggccagggtccactgggccttcaagttctttgactcgcagggggcgcggagccggccgtcccgcgtgtctgacttccgcgagctggggtcccgctcgtgggaggactttgaggaggagctggaggccaggctcgaggatcgcgcccacctgcccggcccggcgcccagggccacccacacgcacggcgccctgatggagacgctgctagactaccagtgggaccggcccgagatcacgtcgcccacgaagccgatcctgcggagcagcgggaggagactgctggacgtggagagcgaggccaaggaggccgaggccgcgctcgggggcttggtgaacgccgtcttcctcctggccccctgtccgcactcgcagagggagctgctgcagttcgtgtctgggtgcgaggcccaggcccagcgcctgccgcccacccctaagcaggtgatggagaagttgttgcccaagagagtccgggaagtcatggtcgcccgaaaaatcaccttctactgggtggataccaccgaatggtctaagttgtgggaatccccagaccaccttggatactggactgtttgtgaactgctccaccacggaggtggcactgtcttgccatctgaatctttcagctgggattttgctcaagctggggaaatgctgctcaggagtggaataaagctgtcaagtgaacctcatctttctccgtggatttcaatgctgccaactgatgccactttaaaccgtttgctctacaattctcctgagtatgaggcctcgtttccacgaatggaaggaatgttatttctccctgttgaagcaggcaaagagattcaagaaacatggacagtcaccctagagcccttggccatgcatcagagacattttcagaaaccagtcagaatttttctaaaaggctcagtggcccagtggtctctcccaacgagcagcactttgggcactgacagctggatgctaggaagtccagaggagagcacagcaactcaaaggctgttatttcagcagttggtaagcaggctgactgctgaagagttacacctggttgctgatgtggaccctggtgaaggccggccccccatcactggagttatttccccactctctgccagtgctatgatcctcactgtgtgccgcaccaaggaggctgaatttcaacgacatgttctccaaacagctgtggctgacagcccccgggacacagcttcccttttctcagatgttgtggatagtatattgaatcagactcatgattcgcttgcagatactgcttctgctgcttctcctgttccagagtgggcccagcaggagcttggccacaccactccctggagtccagctgttgtggaaaagtggtttcctttctgtaacatcagtggtgccagttccgatttgatggagtcatttgggttactacaggctgcctcagctaataaggaagagtcttccaaaactgaaggcgaattaatacattgccttgccgagctctaccagagaaaatctcgtgaagaatccactatagctcatcaagaagacagcaaaaagaaacgaggggtccctcgtactccagtgagacagaagatgaataccatgtgccgttccttaaagatgttgaatgtcgcaaggctgaatgtgaaggcccagaagttacatccagatggcagtccggatgtggctggggagaaaggaatccaaaagatacctagtgggagaacagtggataaattggaagacagaggaagaacactaagaagttctaaacctaaagattttaaaactgaggaagagctgctatcatatatacgtgaaaattaccaaaagactgtggccacaggagaaatcatgttgtatgcatgtgctcgaaacatgatctcaaccgttaaaatgttcctaaaatcaaaaggcaccaaggaattagaagtgaactgcctgaatcaagtaaaaagtagtctcttaaaaactagtaaaagtcttcgacagaatctaggaaaaaaactggataaggaagacaaagttagagagtgccagcttcaggtatttcttcgtttggagatgtgtctgcaatgcccttcaataaatgaaagtacagatgatatggaacaagtagtggaggaggtgacagatttgctgcgcatggtgtgtttaactgaggattcagcgtacctagcagagtttctggaggaaattttgagattgtatattgactctatcccaaagacacttggaaatctttacaacagcctagggtttgtgattcctcagaagctggctggtgtccttcctacagattttttcagtgatgactccatgacacaagagaacaaatcaccacttctttctgtgccttttttgtcaagtgctcgtagatcagtgtcaggcagccctgaatctgatgaactgcaggaacttcgtaccagatcagccaagaagagaaggaaaaatgcattaataagacataaaagcattgctgaggtttcacagaatcttcgacaaattgaaattcctaaagtgtcaaagagagctacgaaaaaagagaactctcaccctgctcctcagcagccttcccagccagtgaaagatacagtgcaagaagtgaccaaagttcgaagaaatcttttcaaccaggaattgctttccccttcaaagagatcactaaagcgggggttgcctagaagccattctgtgtcagctgtggatggtctagaggataaacttgacaacttcaagaagaacaaaggttatcacaaactgctgactaagagtgtggccgagactccagtgcataagcagatctccaaaaggctgctgcacagacaaatcaagggcaggtcctctgatcctggtcctgatattggtgttgttgaagagtcccctgaaaaaggagatgaaataagtctgagacgaagtcctcgaatcaagcagttgtcatttagcaggacacattctgcctccttctattctgtgtctcagccgaagtctcgaagtgtgcaaagagtccactctttccagcaagataagtcagaccaaagagaaaattctccagtccaaagtattcggtctcccaagagtcttctttttggggcaatgtctgagatgatcagcccctcagaaaagggttcagctcgaatgaaaaagcgttcaagaaacactttggattcggaggtacctgcagcttaccagactcccaagaagagtcaccagaaatctctgagcttttctaaaactacaccaagaaggatctctcatacaccacaaactccgttgtatactccagaaaggctgcagaagtcccctgcaaaaatgacccctacaaagcaggcagcttttaaggagtccttaaaagactcctcctcacccggccatgactcaccattggattcaaaaatcactcctcaaaaacgacatacccaggcaggagaaggtacctctcttgaaacgaagacaccaagaactcctaagaggcaaggtactcagccgcctgggtttttgccaaactgtacttggccacattcagtgaattccagtccagaaagcccctcctgtccagcccctccaacttcatcgactgcccagcccaggagagagtgtctcactcccatcagagaccctctcagaacacctccgagagcagcagccttcatgggcacgcctcagaatcaaacacaccaacagccccatgtcctcagagctgctcgggcagaggaaccagcccagaaactaaaggataaagctatcaaaactccaaaaagaccagggaattcaactgtgacttcttccccacctgttacgccaaagaaactgtttacctctcctttatgtgatgtctccaagaagagtccatttaggaaatctaaaatagagtgtccttccccaggagaactggatcagaaagagccccagatgtcacccagcgtagctgcatctctctcctgccctgttccctcaactccccctgaactctcacagagagctacattggacaccgtccctcctccacccccttctaaagttgggaaacggtgtagaaagacctctgatcccagaaggagcatcgtggagtgtcagcctgatgcctccgctactcctggggttggcacagctgacagcccagctgcccccacagactctagagatgaccagaagggactgagcctctctcctcagtctcctcctgaaagacggggctacccaggccctggtctcaggagtgattggcatgcatcctctcctctgctcattacaagtgacacagagcatgtcactctcctcagtgaagccgaacaccatggcattggtgacttgaaaagtaacgtcttatcagtggaagagggtgaggggctaaggacagcagatgctgagaagtcttctctgtctcaccctgggattcccccatctcctccttcctgtgggcctggctctcctctgatgccttcccgtgacgtgcactgtaccacagatgggagacagtgccaggcttcggcacaactagacaacctgccagcatcagcttggcattccacagactctgccagcccacagacctatgaggttgagctggagatgcaagcttctggccttcccaaacttcgaattaagaagatagaccccagctcttcattagaggctgagcccctcagcaaggaggagagctctctgggagaagagagcttcctccctgctctcagcatgcccagggccagcaggtccttaagcaaacctgaacccacctatgtgtcacccccctgcccccgcctctcccacagcacacctggcaagagcagggggcaaacctacatctgccaggcctgtacccccacccacggcccttctagtaccccctctccatttcaaacagatggggttccttggacaccatcccccaagcacagtgggaagacaactccagacataattaaagactggcccaggaggaagagggcggtgggctgtggcgccggctcctcttccgggaggggcgaggtcggtgcagaccttcctgggagcctgtcactgcttgagtcagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagtgcatggcagctaccctccacgggagacgaagaggtgtttgtttccggctccaccccacctcccagctgtgccgtgcggagctgcctctctgccagtgccctccaggctctgacccagtctccgctgctgttccaggggaaaacaccttcctctcagagcaaagaccccagagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatggtcagtgttcagattgccattagaatgccttagggttttctaattccccttatggatccaatccatctcctggccctgccccttgttggggaagttgcaggaggagaggtggatggcaatgtgattggtgctataactcaggcagcctgggagtcaggaacccagacaaggaatcccattccagcctcaccccaaccatgaccttggcaagtcagggggccactctgcctcatttatgcaaatggagaaaggcgccctccctggggtcccttgagctgctgtaaggctgggctgctgcgacacaggcagcgctttgtaaactgtgaagccatatacgtgaaactgaagagtgcattgggcagtggaagctattttttgccttccctgtgtaacagtaaaatcatctctagtgactgagcactcagtacatttttgtttaatgttgggcctgaggttaactgtgaccatggtccagcttgagtggcttctggagcagccacattttcaaggactgtccaagagccagccagttcagggctcaggcctcacccattgcccactcctggggagaccatcacctggctcatcgtttccaccaagagtgccccacaggagtgccccacagacccgctggaccagcctgctgcgggtcctggccaggggtctggctaacggtgagggctgactctgaactgtctctcagtctccagaaagtgttcaagcctgttgtgttcccaaatctgattcctcctattgtcttgtaaatcaaactctaagtgaaaacttcccatttgtcccttcaaagatttttttttattaaatggttttttaagatcc

SEQ ID NO: 5975 - DNA, 994 bp, Homo sapiens
acctgcagtcccagctactgggcagcctgaagcagcaggatggtgtgaacccaggaggtggagcttgcagtgagccgaggtcgcgccaccgcactccagcctgggccacacagcgagattccgtcagaatcagttacttttcgggcacagccccaggccacttactgtgagcctttttctttctcaacaccacattccccacagggaaaacacatttctcacctcaaaagaagacaagacaacgagcaaacaagaaggagcagcaggaggggttctgagccgaggatgccgggcagacatgagggagacacgcacccccgaatccaaccagtgcctcggcacaacgacaaatgtcttcacgtcacagacctttagaggctcctgggcagagcctgaaccagggctcctgactggtctgtttggctcacatggtgttgagattttgccatcactcaatattcagatttcttataaatatccagatttccagcttctcttggaaaatcagaaaaaaacagcactgaactcctaggcccacaaggcactccccagtgaacagatgaaactgtcctctgctgcggggcaggagtctccaggtcacccccatccctccccacctgcctggaccctgaagaagccttctgagtctgtggctcaacgtgcgatgtgcagtgcaagggcctgccccgtagcctgccccgtaggctgccccatagcctgccccgtaagctgccccgtagcctgccccgtaggctgccccgtaggctccatggccactgccccacaaggcctgtctccacaggaatgggaagcggacagggagacgggcagcagctcacatgctgggacaacgcagtgttcaatccattctccatccagcagctccagacatctttccagaacacaaacctgaccccatcacctctctgcttagccactggcttaaactgccaatggtttgcctgcatgtaaaataaagccattctttaccatt

SEQ ID NO: 5976 - DNA, 2742 bp, Homo sapiens
gggcctcggccctggtccaaagtctacccgcctccttgtgacagaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgtgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctgacaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaacacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttcatgtttctcttttagagaatgaattgtttaaa

SEQ ID NO: 5977 - DNA, 2011 bp, Homo sapiens
tatacgcatgcgacttcccggtggccatctttactgtgggctgaagcctgtgcgcttactcgcgcatgtgcaagccttccctcgctttcctcttccaagtagccttgcctagagcggagcctcccgcgccatttctgtgcgcctgcgtagcgtgaccctgcgcagcctgggaggcgggtcttagctccaggtgcgtacggcatctgacttgacgtggcccacaactgaaaggtctggggagaaggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaacccccaggggagcccgatccctgggggaccctggcttcggactccagtatctgtcgtcgcagggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgccggcctcccacgccggaggcccagagcgaagaggagagatccgatgaggagccggaggccaaagaagaggaagaggaaaaaccacacatgcccacggaatttgattttgatgatgagccagtgacaccaaaggactccctgattgaccggagacgcaccccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctatcatctcttaaaaggaggggctgtagctgtagctcaacagttaggccccacttgaagggagaggcagaattgtactcacccagattggaaaatgaaagccagatgggtagaggtgccctcagttagcacctgtcccatctcgggccctccaactcctcccagtcccactccagtgcagccagctggctccaaggtagaaacccatgagcactcagggagcagtgtgccttcagctgcagcagaagcagcccggaggataaaatgagaaccagctgcacacgggccctttaactcccaagccccacccctgggcttggcctgccttgccctgccg

SEQ ID NO: 5978 - DNA, 2254 bp, Homo sapiens
gagggcgcttccggcacagcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttttattttgga

SEQ ID NO: 5979 - DNA, 1201 bp, Homo sapiens
aactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacagcccccatccaggacctcattgcctcattggaaccaaagatgcccctgtcacccaggaaattccaaaggatttaggagctctgcgtcaggagccaggatcacagaccagataatagaacaaaagatgctcctagcacccctgctgcttaggaaatgacacaggttttaggatctctgtgtcaggaactggaggctgagaccaacacatatgttatcatttcacagtgataggtcaaacaggtcatggtaatggtgggagctacctcactgggggcctatgggggtgaaaggagatcatgggtgccctcagcacaccacttgggtgaagggttagtaccagaccccacttctggttttgtctgccagcctggggctttttttttccccttacctattagattatttcataactcttttcctaccagaaatgcatctcctgctagactggtccagatcaaaaccctgctctttcactgaggctctcccggttggcatatcctgcagaatccctccgtccagagatcagtcggtcctgtggttgtttcacaggtgactcctctgtccagagatcagtcggtcctgtggttgtttcacaggtgacacctccgtccagagatcagttggccctgtggttgtttcacaggtgacccctccatccagagatcagttggtcctgtggttctttacccctg

SEQ ID NO: 5980 - DNA, 1199 bp, Homo sapiens
agcggaactccgggtgccggttgaggttgctggtggacctgctctggtggtcttggatgaggccccatgagcgcggcgcccctggtgggctacagcagcagcggctccgaggatgagtccgaggacgggatgcggaccaggccgggggatgggagccaccgtcgtggccagagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagacatatgtcccccggctggtaaggatgaaggtgttccacctcagcctgtcccagagtgtggttctgcgccaccactggatcctccccttcgtgcaggctctgaaagcccgtatgacctccttccacaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctcctctgtctctcttcctctcctctcttcctctcttctctcttcctctcctctctctcttcctcttctctctcttcccctcctgtctctcctcccctcctctcttcctctcctctctcttcctctcctctctctacccctcctgtctctcctcccctcctctctcttcctc

SEQ ID NO: 5981 - DNA, 976 bp, Homo sapiens
acagcggaactccgggtgccggttgaggttgctggtggacctgctctggtggtcttggatgaggccccatgagcgcggcgcccctggtgggctacagcagcagcggctccgaggatgagcccccttcccaggcagagatttccagtacctgacagtgtgctgaacatgttcccgggcaccgaggaggggcctgaagatgacagcacaaaacacgggggacgggtgcgcaccttcccccacgagcgaggcaactgggccacccacgtctatgtaccatatgaagccaaggaggagttcctggatctgcttgatgtgttgctgccccatgcccagagtgtggttctgcgccaccactggatcctccccttcgtgcaggctctgaaagcccgtatgacctccttccacagattcttctttactgccaaccaggtaaagatttacaccaatcaagagaaaaccaggacctttattgggcttgaggtcacttcagggcatgcccagttcctggacctggtttcagaggtggacagagtcatggaggaattcaacctcaccactttctaccaggatccttctttccacctcagcctggcctggtgtgtgggtgatgcacgtctccagctggaggggcagtgcctgcaggaactacaggcaatcgtggatgggtttgaagatgctgaggtgctgctgcgcgtgcacactgagcaagtccgctgcaagtctgggaacaagttcttctcgatgcctttgaagtgagcaccagaggccttcctcctccagggccctctgcagaccaggctgagatggaggaacctgctaaaatcgatggagatgcttctagcctcccagtaggaggccccagccatgccttcaacctggcaggaggtgtagccactcctcatcctccctgagtgctgatattctctctctctctttctcttcctcttctttctctctcttctcctctctttctctc

SEQ ID NO: 5982 - DNA, 2586 bp, Homo sapiens
gcggagctggagccggagctgaagccggagccgggttggagtctgggcgggggccgggccggagcgggctccagagacatggggtcgaccgactccaagctgaacttccggaaggcggtgatccagctcaccaccaagacgcagcccgtggaagccaccgatgatgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacgtgtccccctacctcaagagcctgtccatggtgactgccaacaagttgctgcacctgctggaggccttctccaccacctggttcctcttctctgccgcccagaaccaccacctggtcttcttcctcctggaggtcttcaacaacatcatccagtaccagtttgatggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcattgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccatggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctcc

SEQ ID NO: 5983 - DNA, 3271 bp, Homo sapiens
gcggagctggagccggagctgaagccggagccgggttggagtctgggcgggggccgggccggagcgggctccagagacatggggtcgaccgactccaagctgaacttccggaaggcggtgatccagctcaccaccaagacgcagcccgtggaagccaccgatgatgccttttgggaccagttctgggcagacacagccacctcggtgcaggatgtgtttgcactggtgccggcagcagagatccgggccgtgcgggaagagtcaccctccaacttggccaccctgtgctacaaggccgttgagaagctggtgcagggagctgagagtggctgccactcggagaaggagaagcagatcgtcctgaactgcagccggctgctcacccgcgtgctgccctacatctttgaggaccccgactggaggggcttcttctggtccacagtgcccggggcagggcgaggagggcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacgtgtccccctacctcaagagcctgtccatggtgactgccaacaagttgctgcacctgctggaggccttctccaccacctggttcctcttctctgccgcccagaaccaccacctggtcttcttcctcctggaggtcttcaacaacatcatccagtaccagtttgatggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcattgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccatggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctcca

SEQ ID NO: 5984 - DNA, 8946 bp, Homo sapiens
aggaacattgagcatcctgactttgaaggagtctctgtggtgtttttgtgctaccatacatggggaataatgatgtgaggcagagggagagggaatgaatgggagagccaagagggaagagcgagccggggggaaaggagcgcgcagtgtttcctgctgcggttaggacctcacgccttgccagtacagagctcggtggcaagagccgctgggagctgctcccatcagttagaggatgtggagagggagcaccagaagaggacagcccgcagcctggctcgcagcctgagggacgctgtgggtgctcccagccgggcgagcacgctctgggagcggatctgcaggggagaagcacgcgagcctaacgtgagcgtcccgcctgtcgcgtgtcctgccttggtaagcgccctctccggtccttccacactgaaagcttccagcagagatcaagggaaggagtattgtgtgagacttgcagatttcctcctttctgtctggactggtttgatatttgcctgttgaaaagattactgaacgcagtgtgacaagatgagccgtctagctgcgttctgcttgcctgtgtgtgtgacacgtccaggtgtgaggccaaacctgagaagtgcagactgctcactgatagacgttgctgtaaacagtagtgccctgggtgtacagctggtctcaggatcggagaccccggacttattctctgctcggtgacacggccggcttcctgccgcagagctcctggtttctgttgatggcagttgataattggtagccacagtctgcggtcggagccacagcatttgagtctagcacctggggtgggccctgctgatacagtagagagagagtgaacgaggcagacagaaacacaccccccccccctccacgctcacacactctcccacaccccatgccagctataactgcagctctgagctgcctggagaggagattgccggaagctgaagggatgctttgaacgtgggggggctgcgtcacagttggactcccacttgcagaggacctgattatgtccagtgaccacctgaacaacagcacactgaaggaggctcagttcaaagacctgttcttaaaaaaagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaacttcgtgtgggagtggtgtgggtggtggtttcttatgctttggaagcccctagaaataatgacggaagaatgccatgttgctgatcgtggtaataagccattgtgggttattgtatgtcactagtattagcatagcattcttaaaggaatgcagtgctcaaaacctacccaaattcccgcaggattctaccaaacccttccccaggccagcttttgtactgaaggcaagaactggacagtcagagaacagtggagggggcaagtgactgaagagcaccgggtaaaaagcacaacatgcagttaaaatgcaactagaaaactaattttaaatattgttagttttaatattcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacaggggccatcctctatcttccatccagcggctcttctttttaggaaggctctggtgcagagcacttcaaatatgtcctcaggccagatactgattgctagtagagagacacccggcacccagtccgaagccctccctcaaaggaccggctcatggcgttggtcactggcaggctcagagacattctgctgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccggcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatac

SEQ ID NO: 5985 - DNA, 8686 bp, Homo sapiens
gctgggtctccgagccccggaggaagcaggcgtgtgttgaatttctctctgcccctcaccttggaataaacaggaagcgacaagcacccagcccggcccggcacttgcctttgtgaaggggtctgccctgcacagcctttaggaagcttcctcgggaccccttcccggtgcgccgccccgggtgggcctgggggcgcgccctcggttcaagctctacgttcgtgacatcaaacctcctgttgggccatttccgagaactcccatcagtttctgtatagtgtaaaagtttcagaggcggagcacagagagctgcggctgggacaaggagcacccgcgtgcaggtgcgaccctgcaggatgctggcagcggcgtggccaggggcgcccgtgttctgagggcctgagggccagcccctccacccgcgccatggcctccgcgccctggctggacggctgacgggagcagggaccgccgccgcccaggtgccacacccaggtaccgcccgcccgcgcgagagccgggcaggtgggccgcggatgctcccagaggccggcccagcagagcgatggacttggacaggctaagatggaagtgacctgagcctcgcccggcggcttcctcgacgggacagcgcaagagttggagcacaggcttgtccggggagcagtatgccggaagctggttttcaggccacaaatgctttcacagagtgcaaattcacctgcaccagtggtaaatgcttgtatcttggttcgctggtctgtaaccaacagaacgactgtggggacaacagtgacgaagagaactgtctcctggtgaccgagcacccgcctccgggcatcttcaactcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaacttcgtgtgggagtggtgtgggtggtggtttcttatgctttggaagcccctagaaataatgacggaagaatgccatgttgctgatcgtggtaataagccattgtgggttattgtatgtcactagtattagcatagcattcttaaaggaatgcagtgctcaaaacctacccaaattcccgcaggattctaccaaacccttccccaggccagcttttgtactgaaggcaagaactggacagtcagagaacagtggagggggcaagtgactgaagagcaccgggtaaaaagcacaacatgcagttaaaatgcaactagaaaactaattttaaatattgttagttttaatattcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacaggggccatcctctatcttccatccagcggctcttctttttaggaaggctctggtgcagagcacttcaaatatgtcctcaggccagatactgattgctagtagagagacacccggcacccagtccgaagccctccctcaaaggaccggctcatggcgttggtcactggcaggctcagagacattctgctgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccggcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatac

SEQ ID NO: 5986 - DNA, 8086 bp, Homo sapiens
ctcagctccctgtggtgggggatggcagaggcttcccgctccccgcagctggtttgcacagcctcccgactgtgccgtggtgtctccttccctaaagtgggacagtcgtttctgtgtcctgctggcctctgaggaacagacgtgtgtgagaggccttcagggcctgatggctggggtggtgacagtgcctggagaatgggtggggactggaggggccaggtggctaaccactctcctcttccatggcagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcaggaagggtgcctgtggccttcagacagcgccgcaccgcggctgggcgcctcggagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaacttcgtgtgggagtggtgtgggtggtggtttcttatgctttggaagcccctagaaataatgacggaagaatgccatgttgctgatcgtggtaataagccattgtgggttattgtatgtcactagtattagcatagcattcttaaaggaatgcagtgctcaaaacctacccaaattcccgcaggattctaccaaacccttccccaggccagcttttgtactgaaggcaagaactggacagtcagagaacagtggagggggcaagtgactgaagagcaccgggtaaaaagcacaacatgcagttaaaatgcaactagaaaactaattttaaatattgttagttttaatattcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacaggggccatcctctatcttccatccagcggctcttctttttaggaaggctctggtgcagagcacttcaaatatgtcctcaggccagatactgattgctagtagagagacacccggcacccagtccgaagccctccctcaaaggaccggctcatggcgttggtcactggcaggctcagagacattctgctgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccggcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatac

SEQ ID NO: 5987 - DNA, 8892 bp, Homo sapiens
aggaacattgagcatcctgactttgaaggagtctctgtggtgtttttgtgctaccatacatggggaataatgatgtgaggcagagggagagggaatgaatgggagagccaagagggaagagcgagccggggggaaaggagcgcgcagtgtttcctgctgcggttaggacctcacgccttgccagtacagagctcggtggcaagagccgctgggagctgctcccatcagttagaggatgtggagagggagcaccagaagaggacagcccgcagcctggctcgcagcctgagggacgctgtgggtgctcccagccgggcgagcacgctctgggagcggatctgcaggggagaagcacgcgagcctaacgtgagcgtcccgcctgtcgcgtgtcctgccttggtaagcgccctctccggtccttccacactgaaagcttccagcagagatcaagggaaggagtattgtgtgagacttgcagatttcctcctttctgtctggactggtttgatatttgcctgttgaaaagattactgaacgcagtgtgacaagatgagccgtctagctgcgttctgcttgcctgtgtgtgtgacacgtccaggtgtgaggccaaacctgagaagtgcagactgctcactgatagacgttgctgtaaacagtagtgccctgggtgtacagctggtctcaggatcggagaccccggacttattctctgctcggtgacacggccggcttcctgccgcagagctcctggtttctgttgatggcagttgataattggtagccacagtctgcggtcggagccacagcatttgagtctagcacctggggtgggccctgctgatacagtagagagagagtgaacgaggcagacagaaacacaccccccccccctccacgctcacacactctcccacaccccatgccagctataactgcagctctgagctgcctggagaggagattgccggaagctgaagggatgctttgaacgtgggggggctgcgtcacagttggactcccacttgcagaggacctgattatgtccagtgaccacctgaacaacagcacactgaaggaggctcagttcaaagacctgttcttaaaaaaagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaacttcgtgtgggagtggtgtgggtggtggtttcttatgctttggaagcccctagaaataatgacggaagaatgccatgttgctgatcgtggtaataagccattgtgggttattgtatgtcactagtattagcatagcattcttaaaggaatgcagtgctcaaaacctacccaaattcccgcaggattctaccaaacccttccccaggccagcttttgtactgaaggcaagaactggacagtcagagaacagtggagggggcaagtgactgaagagcaccgggtaaaaagcacaacatgcagttaaaatgcaactagaaaactaattttaaatattgttagttttaatattcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacaggggccatcctctatcttccatccagcggctcttctttttaggaaggctctggtgcagagcacttcaaatatgtcctcaggccagatactgattgctagtagagagacacccggcacccagtccgaagccctccctcaaaggaccggctcatggcgttggtcactggcaggctcagagacattctgctgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccggcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatac

SEQ ID NO: 5988 - DNA, 8632 bp, Homo sapiens
gctgggtctccgagccccggaggaagcaggcgtgtgttgaatttctctctgcccctcaccttggaataaacaggaagcgacaagcacccagcccggcccggcacttgcctttgtgaaggggtctgccctgcacagcctttaggaagcttcctcgggaccccttcccggtgcgccgccccgggtgggcctgggggcgcgccctcggttcaagctctacgttcgtgacatcaaacctcctgttgggccatttccgagaactcccatcagtttctgtatagtgtaaaagtttcagaggcggagcacagagagctgcggctgggacaaggagcacccgcgtgcaggtgcgaccctgcaggatgctggcagcggcgtggccaggggcgcccgtgttctgagggcctgagggccagcccctccacccgcgccatggcctccgcgccctggctggacggctgacgggagcagggaccgccgccgcccaggtgccacacccaggtaccgcccgcccgcgcgagagccgggcaggtgggccgcggatgctcccagaggccggcccagcagagcgatggacttggacaggctaagatggaagtgacctgagcctcgcccggcggcttcctcgacgggacagcgcaagagttggagcacaggcttgtccggggagcagtatgccggaagctggttttcaggccacaaatgctttcacagagtgcaaattcacctgcaccagtggtaaatgcttgtatcttggttcgctggtctgtaaccaacagaacgactgtggggacaacagtgacgaagagaactgtctcctggtgaccgagcacccgcctccgggcatcttcaactcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaacttcgtgtgggagtggtgtgggtggtggtttcttatgctttggaagcccctagaaataatgacggaagaatgccatgttgctgatcgtggtaataagccattgtgggttattgtatgtcactagtattagcatagcattcttaaaggaatgcagtgctcaaaacctacccaaattcccgcaggattctaccaaacccttccccaggccagcttttgtactgaaggcaagaactggacagtcagagaacagtggagggggcaagtgactgaagagcaccgggtaaaaagcacaacatgcagttaaaatgcaactagaaaactaattttaaatattgttagttttaatattcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacaggggccatcctctatcttccatccagcggctcttctttttaggaaggctctggtgcagagcacttcaaatatgtcctcaggccagatactgattgctagtagagagacacccggcacccagtccgaagccctccctcaaaggaccggctcatggcgttggtcactggcaggctcagagacattctgctgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccggcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatac

SEQ ID NO: 5989 - DNA, 8032 bp, Homo sapiens
ctcagctccctgtggtgggggatggcagaggcttcccgctccccgcagctggtttgcacagcctcccgactgtgccgtggtgtctccttccctaaagtgggacagtcgtttctgtgtcctgctggcctctgaggaacagacgtgtgtgagaggccttcagggcctgatggctggggtggtgacagtgcctggagaatgggtggggactggaggggccaggtggctaaccactctcctcttccatggcagcggagctggagttcgcccaaatcatcatcatcgtcgtggtggtcacggtgatggtggtggtcatcgtctgcctgctgaaccactacaaagtctccacgcggtccttcatcaaccgcccgaaccagagccggaggcgggaggacgggctgccgcagatcatgcatgccccgcggtccagggacaggttcacagcgccgtccttcatccagagggatcgcttcagccgcttccagcccacctacccctatgtgcagcacgagattgatcttcctcccaccatctccctgtccgacggtgaagagccacctccttaccaggggccctgcaccctgcagctccgggaccctgaacagcagatggaactcaaccgagagtccgtgagggccccacccaaccgaaccatatttgacagtgatttaatagacattgctatgtatagcgggggtccatgcccacccagcagcaactcgggcatcagtgcaagcacctgcagcagtaacgggaggatggaggggccaccccccacatacagcgaggtgatgggccaccacccaggcgcctctttcctccatcaccagcgcagcaacgcacacaggggcagcagactgcagtttcagcagaacaatgcagagagcacaatagtacccatcaaaggcaaagataggaagcctgggaacctggtctgattccttccaacgtgcacttcagctggagaaagaaaccaagaagggaagcggccgctgggcccctcctgcgcacagtgttgttcagtttcacatggtacaaataagtaaaaccaaatgagcaaacacggtctttgtttctgattccttttaggggaattgcatgcaaactagactgaaatgatacaaacttccatctggtctgaccgcaaacagtgtttatttggggacaggggttgggatgggggtgtgggcaggggaaaacagagaacgggatgctttgaagataccatgaaataaaacccacagaggtatttgatgtatttaattgtgaaaggagactttgcagataaatgaggccagaatggcatgttttataattaactgaataaagaaggaagcattattatatattattgtggggaagaaccagccagttcgctttttctcctaaggtgtggaacttttattttgttttaaaaatatgaatcaaaattcctgtgttgtgtgccaaggtataaagtggagaagttagatgagtgcaaggagctcctttgtgttgtgatgatgtgttttaaaagttgcactatcttaatgttgaaaatatttacaagggaactgttttacgtgaagttctgtatgttgtcttttcacctgtggattgtaatcaggcccaaggaatatcctggagtggtccccagaagcatccaagaaaagatatttggggacgtagcctaacattttaccaacttacgtaaatcaaaaaagtcattattgttgcaggagtttgcatcaaatagcagtgcatcgctgaagcttttggagacttttggatggaagataagatagggaagattaagttccagcatttctgacttgttattttgagttactctgctactcttaggctgcatagtttatgagaaaatgaacacatgcatttatggatccagtatcatgcagtgctgccctcatcctccagcagtgcaatttcttcagtaatttagatttttttcactatagcatgaaatatattcaaatacataccttattttatgcaataaattgtttaaaatgcaaggtggttattctgcatactgttgaaatatgtgactcctcagtatattcccattgcctctccccctttcctcgacagcttagttcagttctgcagggctgctcagttcacaggaggctcccagcagccaccccacatccagcctacacagaacttcgtgtgggagtggtgtgggtggtggtttcttatgctttggaagcccctagaaataatgacggaagaatgccatgttgctgatcgtggtaataagccattgtgggttattgtatgtcactagtattagcatagcattcttaaaggaatgcagtgctcaaaacctacccaaattcccgcaggattctaccaaacccttccccaggccagcttttgtactgaaggcaagaactggacagtcagagaacagtggagggggcaagtgactgaagagcaccgggtaaaaagcacaacatgcagttaaaatgcaactagaaaactaattttaaatattgttagttttaatattcctgatatttacaaatattcattcttatatacaatgaaaaaaataactttcttctgcagatgtaagcactggcttttataagagcagcagccaacacgtttagcagacactgcgcgtggagaagggcttatctgcagtacactctgccatgtggagggtgggcctctgtggcctcttcacataacaagatgagctggaatgatgattccatgactcccacctatgcagccttaaagccaaatccgcgtgtgtgtgtttgtgtctgtctgtgggtctcgaaggtgatccgtcggtgcggtggctctgtgctgtaactggagagactgttccaaaccccaagagttgtctgatcctagtctgttcccttctgcttcttacctctgtagataggtcactggtttttgtttgtttgttttgaggattggaatttccattacattcatcctttgcacacagtaacatccacagaactagtccaactcttaaaaggagagaggaaaaacacaggcaccagttgtcagctcatgcttacaacctgtgtggaagtatatacagttgagagtcacagtggaggttctgagactggattcagtcttgttccagtgacagttggaaggcctctgctggagagacaccagctctcagggcagagattggcttggggccagaaggaccctccccaaccctggagacaccctgaaggttcactggctctccagattagcctctcttcctctgtcaggcaaagatgaggagcccgtgttcccatcgggccctgctggcagggacttgcagtggattcttggtcaggtgtgcccacagatgcggaggcgaggtgagtgattccatcatttcagttctcacctgcagttttggtgaagcaggagatgcaccccacagctctagctctcaaatggcttcacagtccttacttctctacctgcctcaagaaggggctcagagcagagacttgtgaattccttagtaactgtgagtatatgaatgtgttgcacatgtccacagtattggcgagataattacataattcagatacctttaatcatctttcaagaaagaggctcctcccattcaaccaccctagagaactgcctttgttaaatagttatttaaagactcatacatatcaaaccatgactttgaaaggtcttcgaggctggggctctgtaatgaattagtttaaaagccaaggtcataacatgaattgatggtcaatttcccttcagcagaaggaaaaggtgatttagatcagtagctcttttgaaggttgtggctgacctgttcataccgtgtcgcctcatggctagtgtggcgttgaaagagtagcgactgggaagatacaacttacacagtggggcctattgttctttcaagaaccctttttttagcttatagaacccatgggtccagtttagtaacgagtgatttaggcaatcaatgataggtttataatcttagattattccagcaaagtgtggattgcattgttaggaagaacatttggtgggaatgaacactcctgggcataccgctgacttttgtcccttgttcccggtgtaggagacccaaggcatcttgaatcccatctataagaacacaatcttccagcatacgtttgctttttcagaaactctagcattctctttaaatactgacgcaatccttaatggaaaagagatttcatgaagcaaattatgtatttcaatagttcttctatttttagtgtccaaaatttactaatacagaagcttgacaagcatgtcctcaccctccccaccacataaacacatggacacacacccaagccacaagaaatcccaagagagcagaagcgaatttttaaaagatttatcgtgaggactgcatttccattcactaattttggctcaaacttatgaggcaggaaataggggccaacagtaaatgggggaggcctcctgacaccagcagaggaattttgtacccaggcgaggacttcttgaacttctgcgtatctccgtttgatctctttcacctttatttcatcttcataagaatgagaaaggctcaaaaggaagcacttttagaaatcttctctgacctagaagaatccatccaaatccctgccttcctctctgaaccaacagttcccttctctgacaggggccatcctctatcttccatccagcggctcttctttttaggaaggctctggtgcagagcacttcaaatatgtcctcaggccagatactgattgctagtagagagacacccggcacccagtccgaagccctccctcaaaggaccggctcatggcgttggtcactggcaggctcagagacattctgctgtgggcgcagggagcccggccccccatgcagccatgactggatgcgcccccatctcgggggcttgctgcactgcttgtttattgaattttgctacttagaatggcaacattaactttgtgtaccattcattttttaaaaattttccaaagctcggcagtgtatgaaagaaaaaactgggaaagatacttggtttctgttaacttttgtgttgcttgcttaagtgattaaagccagtgcttggagccaagccttcatgccacgaacatgctccacagcctgccctttgctctcctgctcacactgaccaagaatgccgcgtgcttggcctactgaggtgaaaggacaattgaatgacaggtgggcaaagggagaacttccccttcttggtgcgaggaaagtcacaaatttaaaaatgttgcttccagcccagatcctaaatgctagttctcagcagctgcgtggcttaccgttcgccatttccaccaccgccagctgccagcaccgctacagatcacagagatgtgaacagacaatggaaagcactcttagccttgcagtggtctacattttttaggaaccaatatttcagcattctttattacccggcacgctgtgtcctttgcagagttcaagtttatgttactgccagggtcagacagtcatttgctgctgctgctgctgctgctgcttctcgaactggatgcattaggaagctgctgtctgagtgtaggaatgtcttgctaagaaagcaatgtcttccttcatccttttctttcttccctctgcgtgtccttgtttttgtgtaatgcgggagagggttagagctatagagattatatatacactatccgtgcacattatatatatgtagatatacccctatcatgtcagagatctgcatgtcagtttttcagcaactaaggtgcctcatgttctgagttcagcagatataggaaccaagccgccccctcctgcacttgatgctcccacctttgttgtgcctcacttaaaatggtgcttttttcagttgtctgtcttttcttatgtttttatttgtaaggtgctgtatataagttgaatatattatgcacatatcctacccaatgggtagaacaaaaagttgttaatactgtaatataatgtatagatgataccaattttaacagaaatggcatagaatttgtgaatgcctatgtgctttgtcctcttttgtaaggaaatttgcaaatggatgcatacagattaaagtctatgtagtttattttcctattaaatatcaatattataacacaagagaaagaagtgtgaacaaacaagcaacagtttatgaccagcgtatatatagcaatggaaagttgcatctttgctgtgaaaacactttaaagaaaatactttttaaaaaatcccacagctttttggttgccactagacgcttcttattttaatcattttagtaatgctcagctggaccagtgttagttatatttgagtcagaaaaatgttgtttttcaacttgctttataatctcctgcatctatctcctgctgtagcatcacgaaggtgtcaggcaacagtgaaaagtgcacatttttgttgttgcagaaactgtgtcagaggaataagtaaatcagcctgcagcagaagactttgttcagctccagaggcatctgtgaccgtctgtgtccaagtctctctgtgcctttttcttttacaaactgaagctgtggagccaatgaagtaacagtagagattgtagggaaagaatacctcaggaaaaacaaatacacttacaagaagaccctgttcttagaaaatgtgtttagttatgggttagcactagaagagacttggctgtcagccagccaagtgaaggacctctcatccattcccattcatgtcccatcataatacggacccaaaaagcaaactcggttttgccatcagttagaaattacgttttggattgtatattgttacatctctcttccggcttagtttttagtgtctgattgtgacctctgcatttatcttcaaataccctaattttaaaacaaaagaacaagaaaagtttataacaccatgttcactaaaaccacggttgaatcttgggtgtgggcatcctttcgagtgttgtccataagagcagttcgtggaattttgcccatctgacccatattatcagcttattctgccaccagagtagagtctaataaattccaaagtttttatttgctccatggtgtatgttctgactttgaaaatgtcagattctataatcatacccctaacatccaggaaacaaatgacagattatctttaaactgaaattgactctacaatgcaacccttaatgctgaatggattaaaaaagtcagcccttttagtatctgtttgaaagggccgtaaaaagttgacacttttgttgttgtggatcctgcgtgtctagacccacgtgttgtttccatcgtatactgtagggtgcaccccttgggattcatcattaagaactgaggctcactgttgtcagaaacaaagctcccaccccccaggttcaaccttgtgggagaactgttgagcatgagaatgttctagactcagaggtactaaaatttgttaccacatcattgcttcctttctacaggacgaattgaggcttaaactttactgttaatgatactggttcattttaatgtgcttgttggtatgttgctatttttcatttcatagctttcaaaaatcatgctaattgtatacttgtctagtttaaggctattttaaaatatgtacaatactattcacagcatttagttcgtttaatttttattataaagcaatctactaaaaaagtacaactgtatttgaacttttcaatagttgtttgtgagctatgataatcaaaagtcattaaagtcttttttaacaaacattcgtgcttacttttcaacataattcccagttatatacagaaaaagatttccacctgtcacgtatctgcctcttttacctgagcaatggtgtagttcttagacctaaggtctgtaattgcaatacttttaaagaaagatgttgctctaagtgctgtttgttagttatgaaatcagatttttctgcttgttcttaatgctgtggtcaaaccatagcacaaaatcattaaaaataatcagcggcatac

SEQ ID NO: 5990 - DNA, 5237 bp, Homo sapiens
tgcgcactgctggagacgggcgaccttcgctggccggtcggtgggttcctggttttctgctgccgagtaaacaaacgttccctttcctaacttagcagtcacagagctatttccaagagttgttcttaatttcctgtgcgatattcccattggctatttaacactgaacattctgtttttgaatcaaagttagttaaaatttgttgtcaataagtttaacattctgttcttccgcgtgatggattttcttttggagattcgaactgaagcctgtacggaggaaatgttgtttttaagggaaatgaatagaaacaatccactttgaagaagccatggcgaaatcaaagacaaaacatagactttgttctcaggaatcttcagtatctgccctgctggcaagctgcaccctgagtggtagtaattcctctaattctgatggctcgtttcactataaagataagctgtacagatctgcttctcaagctctacaggcttatattgatgattttgatctaggccaaatatatcctggtgcaagcactggaaaaattaacattgatgaggattttactaatatgtcacagttctgcaactatatttacaaaccaaacaatgcttttgaaaaccttgatcacaaaaagcactcaaacttcatatcctgtagaagacacaccgttaatgacatagactccatgagcctaacaactgatgatctattaagactcccagcagatggatcattttcttatacttatgttggaccgagtcaccgaacgagcaagaaaaacaagaaatgccgtggaagactgggttcattggacattgagaagaatccacattttcaaggaccctacacttccatgggcaaggataactttgttactcctgttatacgctcaaatataaatggaaagcaatgtggtgacaaaattgaattgcttatcttgaaggccaagagaaatctagagcagtgtactgaagaattaccaaagtccatgaaaaaggatgacagtccttgctcattagataaacttgaagcagacagatcatgggaaaatattcctgttactttcaaatctcctgttcccgttaactctgatgatagtcctcaacaaacttcaagggcaaagagtgctaaaggggttcttgaagactttctaaataatgataatcagagctgtactctctctggaggcaaacatcatggtcctgttgaagccctgaaacaaatgttatttaaccttcaagcagtacaagaacgttttaatcaaaataagaccacagatccaaaagaagagattaaacaagtttcagaagatgatttctctaaattacagttgaaggaaagtatgattcctattactaggtcacttcagaaggctttgcaccatttatctcgcctgagagacctggttgatgatacgaatggagaacggtcaccgaaaatgtgaagaggaaaatgaaactgtcaccacaatgaatagtcaccacagaacaaataggcattttttctattacttaaactgacaaagtaaatataagccatacattattttgtggttggttcaaggattatatatttctaaaacactaaacttgaaaatacccataggttttgggacctatctttattttgtgccaacatactagaatgtgaactgcaaggacccacaatatatcctgaagtcttactttcgccttctggccagcaaatgtctaatatttaaagatggatgacttctgttcttgaagcttacctggatttaaccttcttcagcatcctcaacattttattacctggttcaggatcattaagaaacttactggtttttatccaaaatcttttacgttaaatagacttttttaaagatatagttagcatcacttttaaacagcttaaaggaatatcaaaattgttattgtgtatctcatctataaggaagtctgttactttgaaattttcataaatttaatatttaagatacattgtatttgaaaattgcattaatagtggggtgatactgtgttaaaaggaatgttgtgttgtgacattcaagagaacctcctcatttaattagtactttgattctgtgtaagataatcttggtagtgcttgacagtttccaaacctttttttggagagatatttaagaatttaatattttgatattagattgtttcccagattttaattttggggttggctcaaactagtgaaaactatgactcaatggccaattgctttatcaaatttgataactaaaacttaaaatgaatatggaaaatcagaaagcaactctattttagagctattttgtaagagttgtgctttctttaacaccatctgtagtcttaagtttgtctctagctagaactgaacaaagctctataatttttaccaagcacttattattaatacttcttataagtagtaagcatctttactaacacaactgagaattaagtcataaaacataactaatacagcacattactgcctgacaaaattaaagagtactgtgtgtatgtataactactacaggttaacacttcacccaaatgatagcgtttttcctcagtagattattgtcaaataggaatttctaagcacattgagtcaaagcattttttccaagttaataaagtgttatttactatctttgttagaggtgacatgtcaaacactacagtgagctctgtggggttttttttttttttttttgcccgtgagttttttaccatgctgctctgaccagtttgagtggcaattaccaatagatttgttttctttattctatggagatgtttttaccactgacactgttttctgattatagtctgcttcatagaaaatagcctgcataatcaaacaaggagttactttgaaattaaagtatgcctggctattaaaaatgcagattttaggtgggtaaacatcaggtaggtctgggtgggtcatgttctaggcctagaaaaatacactattagacaagttctaaagaaggcaaggagataaaggcatcaggtggtaacttctaattgaatattatatgttgatcatacataatatatactatgcctggaaattatgactgaaaagcacctattcggttagtgctcctattcatgagaacatatctccaatactaaatgagataagcctgttctaaaatcttatagccagtattttaagaaacttgattatacttaccaaaggaacattgtttgttttctcttgttttaaatatggagaggtttaatcctttacataacaaaggaattaattttagcaaaatgattcattccaaccttcttataagaaatatctaggagagtcaagtaagaaaaataacgaatctaagtgataaacattcaagaaattctctaaataagagatttatttataattttaatatctcagggttctttttaggtttccaggggaaaagagcaggataacagtgtggagactgctaagttgagaatttaaaacaaatgagaacataagatttttaaaattgcattgtgaatgtaaaatttttatcaatcctttgctctcttttagacatattgagaaaatgttaaatagaaaaaattaagaaattttaataagatgtttcagatctttgagtatgaaaaacataacaaaaaaagcctaatttcaaaaaactatttgagatcaagggacaatggtgtgaccaatatgaagggtcaagactgaaatgtattgtctttactatcaagaactctactttcagttgtttctcagacagttaatttcagcttcatagagatttctgagcaaattaagaaacactgttttcctgggtttgttttgggtatatgtcattatagttatgttatttcttgttgaaatttataattgtaggttttttgtattgttttagtatttaatggtgtataatgtgttattacattatatgtagttataccaaaatattgcctgaagataaatcatgacaaggtcccctgtttattcctgtgttacagacgcatggaattgctcctgtagatttgaatttttgtttcatttttttctgtcccacccttcactctctctgtttcagaacatttttggtagaagtgctatccagaagtgaacttgtcaaaaggcaagtagcatgaaagaagacagaagaagcaaaaggctaatacagtggataatttctgagcacttgaagtttcttcaaatgtgcaagactgtgtgtcttcctattagatgtataaattggatatttcatgcctaattaaatgttgcgttggattgcagtgcctatcatacagtgattggagtaaattgaggcctaatcctgaacacatatagagcatattgttagatatttttcctgtgacatttgaagttattattctcccatttcctttttctttttttgtttataatcatatgtccctaagattgttttccttttttggaccaaaaaaaagaaaaaaaaaatcttagcttttcatcctcccagtgtattctgcattgtccttaccctagatcagccccttctgtgttaacagtttttctcacaatgtagcaacttttatccacccttcaggaccttcactgggactagttcattcattttcaaatagctatttcaacctttaacatctactgtcttagtcttttacacagaagccagagtgactggtcttggcaagactctgttgtgtatcaccactctaaccttactgatttgtttcagcaaatttgctttagttaaattgctttactcagattcccccaaactttatatgtgtattgtcatctttgtgcatattatttctcatgcatgaaatactcaatttttattcttttatctaacgcttactcttacatttctttaaagctctggccaagtattttatttcgtccctaaacattctaactatccaccaaactggtaagttggcttttctttttcctccccctgtcattcatttagctgttatatttcattttaatgttttgggtggtgcctcttatactatgttgtattcctagacaaggaaatgtatatcaaaatatgttagatgattgattgttttatctccttgatgatagcacctcttatactgctttacagaatcaggaaaaagtaaactgcattttacatagtggttttaaatattgattgattgatattctaaacctggtttcctatataaagttgtaagttcaagataaagagaccacattctttact

SEQ ID NO: 5991 - DNA, 5506 bp, Homo sapiens
taacattctgttcttccgcgtgatggattttcttttggagattcgaactgaagcctgtacggaggaaatgttgtttttaagggaaatgaatagaaacaatccactttgaagaagccatggcgaaatcaaagacaaaacatagactttgttctcaggaatcttcagtatctgccctgctggcaagctgcaccctgagtggtagtaattcctctaattctgatggctcgtttcactataaagataagctgtacagatctgcttctcaagctctacaggcttatattgatgattttgatctaggccaaatatatcctggtgcaagcactggaaaaattaacattgatgaggattttactaatatgtcacagttctgcaactatatttacaaaccaaacaatgcttttgaaaaccttgatcacaaaaagcactcaaacttcatatcctgtagaagacacaccgttaatgacatagactccatgagcctaacaactgatgatctattaagactcccagcagatggatcattttcttatacttatgttggaccgagtcaccgaacgagcaagaaaaacaagaaatgccgtggaagactgggttcattggacattgagaagaatccacattttcaaggaccctacacttccatgggcaaggataactttgttactcctgttatacgctcaaatataaatggaaagcaatgtggtaggctgaaaaacccaaaacttatgaataggactaataattgcatttctgaatcatctttgtcttttcccaagaaatcgtctttcaaggacagttcagaacacagtcttgaaaagaattacccaagatggctcactagccagaaatctgaccttaatgtttcagggataactagtatacctgatttcaaatacccagtctggctgcacaatcaagacttgctacctgatgcaaatagtcaaagggtttatcagatatttaaagatgatcagtgttcccctagacatagtcatcaggcacaaggaacttctcggcttatcaataaattagattgttttgaatatgcttttgaaccctcaaacttttcaaattccttgagtgatgataaagaattagttaatgaatacaaatgtgattttgaacatagccagtgtcaatgtgagaatccacttctcccaggacaatccacaaagccattcagtggtgacaaaattgaattgcttatcttgaaggccaagagaaatctagagcagtgtactgaagaattaccaaagtccatgaaaaaggatgacagtccttgctcattagataaacttgaagcagacagatcatgggaaaatattcctgttactttcaaatctcctgttcccgttaactctgatgatagtcctcaacaaacttcaagggcaaagagtgctaaaggggttcttgaagactttctaaataatgataatcagagctgtactctctctggaggcaaacatcatggtcctgttgaagccctgaaacaaatgttatttaaccttcaagcagtacaagaacgttttaatcaaaataagaccacagatccaaaagaagagattaaacaagtttcagaagatgatttctctaaattacagttgaaggaaagtatgattcctattactaggtcacttcagaaggctttgcaccatttatctcgcctgagagacctggttgatgatacgaatggagaacggtcaccgaaaatgtgaagaggaaaatgaaactgtcaccacaatgaatagtcaccacagaacaaataggcattttttctattacttaaactgacaaagtaaatataagccatacattattttgtggttggttcaaggattatatatttctaaaacactaaacttgaaaatacccataggttttgggacctatctttattttgtgccaacatactagaatgtgaactgcaaggacccacaatatatcctgaagtcttactttcgccttctggccagcaaatgtctaatatttaaagatggatgacttctgttcttgaagcttacctggatttaaccttcttcagcatcctcaacattttattacctggttcaggatcattaagaaacttactggtttttatccaaaatcttttacgttaaatagacttttttaaagatatagttagcatcacttttaaacagcttaaaggaatatcaaaattgttattgtgtatctcatctataaggaagtctgttactttgaaattttcataaatttaatatttaagatacattgtatttgaaaattgcattaatagtggggtgatactgtgttaaaaggaatgttgtgttgtgacattcaagagaacctcctcatttaattagtactttgattctgtgtaagataatcttggtagtgcttgacagtttccaaacctttttttggagagatatttaagaatttaatattttgatattagattgtttcccagattttaattttggggttggctcaaactagtgaaaactatgactcaatggccaattgctttatcaaatttgataactaaaacttaaaatgaatatggaaaatcagaaagcaactctattttagagctattttgtaagagttgtgctttctttaacaccatctgtagtcttaagtttgtctctagctagaactgaacaaagctctataatttttaccaagcacttattattaatacttcttataagtagtaagcatctttactaacacaactgagaattaagtcataaaacataactaatacagcacattactgcctgacaaaattaaagagtactgtgtgtatgtataactactacaggttaacacttcacccaaatgatagcgtttttcctcagtagattattgtcaaataggaatttctaagcacattgagtcaaagcattttttccaagttaataaagtgttatttactatctttgttagaggtgacatgtcaaacactacagtgagctctgtggggttttttttttttttttttgcccgtgagttttttaccatgctgctctgaccagtttgagtggcaattaccaatagatttgttttctttattctatggagatgtttttaccactgacactgttttctgattatagtctgcttcatagaaaatagcctgcataatcaaacaaggagttactttgaaattaaagtatgcctggctattaaaaatgcagattttaggtgggtaaacatcaggtaggtctgggtgggtcatgttctaggcctagaaaaatacactattagacaagttctaaagaaggcaaggagataaaggcatcaggtggtaacttctaattgaatattatatgttgatcatacataatatatactatgcctggaaattatgactgaaaagcacctattcggttagtgctcctattcatgagaacatatctccaatactaaatgagataagcctgttctaaaatcttatagccagtattttaagaaacttgattatacttaccaaaggaacattgtttgttttctcttgttttaaatatggagaggtttaatcctttacataacaaaggaattaattttagcaaaatgattcattccaaccttcttataagaaatatctaggagagtcaagtaagaaaaataacgaatctaagtgataaacattcaagaaattctctaaataagagatttatttataattttaatatctcagggttctttttaggtttccaggggaaaagagcaggataacagtgtggagactgctaagttgagaatttaaaacaaatgagaacataagatttttaaaattgcattgtgaatgtaaaatttttatcaatcctttgctctcttttagacatattgagaaaatgttaaatagaaaaaattaagaaattttaataagatgtttcagatctttgagtatgaaaaacataacaaaaaaagcctaatttcaaaaaactatttgagatcaagggacaatggtgtgaccaatatgaagggtcaagactgaaatgtattgtctttactatcaagaactctactttcagttgtttctcagacagttaatttcagcttcatagagatttctgagcaaattaagaaacactgttttcctgggtttgttttgggtatatgtcattatagttatgttatttcttgttgaaatttataattgtaggttttttgtattgttttagtatttaatggtgtataatgtgttattacattatatgtagttataccaaaatattgcctgaagataaatcatgacaaggtcccctgtttattcctgtgttacagacgcatggaattgctcctgtagatttgaatttttgtttcatttttttctgtcccacccttcactctctctgtttcagaacatttttggtagaagtgctatccagaagtgaacttgtcaaaaggcaagtagcatgaaagaagacagaagaagcaaaaggctaatacagtggataatttctgagcacttgaagtttcttcaaatgtgcaagactgtgtgtcttcctattagatgtataaattggatatttcatgcctaattaaatgttgcgttggattgcagtgcctatcatacagtgattggagtaaattgaggcctaatcctgaacacatatagagcatattgttagatatttttcctgtgacatttgaagttattattctcccatttcctttttctttttttgtttataatcatatgtccctaagattgttttccttttttggaccaaaaaaaagaaaaaaaaaatcttagcttttcatcctcccagtgtattctgcattgtccttaccctagatcagccccttctgtgttaacagtttttctcacaatgtagcaacttttatccacccttcaggaccttcactgggactagttcattcattttcaaatagctatttcaacctttaacatctactgtcttagtcttttacacagaagccagagtgactggtcttggcaagactctgttgtgtatcaccactctaaccttactgatttgtttcagcaaatttgctttagttaaattgctttactcagattcccccaaactttatatgtgtattgtcatctttgtgcatattatttctcatgcatgaaatactcaatttttattcttttatctaacgcttactcttacatttctttaaagctctggccaagtattttatttcgtccctaaacattctaactatccaccaaactggtaagttggcttttctttttcctccccctgtcattcatttagctgttatatttcattttaatgttttgggtggtgcctcttatactatgttgtattcctagacaaggaaatgtatatcaaaatatgttagatgattgattgttttatctccttgatgatagcacctcttatactgctttacagaatcaggaaaaagtaaactgcattttacatagtggttttaaatattgattgattgatattctaaacctggtttcctatataaagttgtaagttcaagataaagagaccacattctttactca

SEQ ID NO: 5992 - DNA, 1042 bp, Homo sapiens
ggcggacgctccacgtgtccctcgccgcgccccgtctacccgcccctgccctgaggaccctagtccaacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggacaaatatacgtgtatgttcacttacgcctctcaaggagggaccaatgagcaatggcagatgagtctggggaccagcgaagaccaccagcacttcacctgcaccatctggaggccccaggggaagtcctatctgtacttcacacagttcaaggcagaggtgcggggcgctgagattgagtacgccatggcctactctaaagccgcatttgaaagggaaagtgatgtccctctgaaaactgaggaatttgaagtgaccaaaacagcagtggctcacaggcccggggcattcaaagctgagctgtccaagctggtgattgtggccaaggcatcgcgcactgagctgtgaccagcagccctgttgcgggtggcaccttctcatctccggtgaagctgaaggggcctgtgtccctgaaagggccagcacatcactggttttctaggagggactcttaagttttctacctgggctgacgttgccttgtccggaggggcttgcagggtggctgaagccctggggcagagaacagagggtccagggccctcctggctcccaacagcttctcagttcccacttcctgctgagctcttctggactcaggatcgcagatccggggcacaaagagggtggggaacatgggggctatgctggggaaagcagccatgctccccccgacctccagccgagcatccttcatgagcctgcagaactgctttcctatgtttacccaggggacctcctttcagatgaactgggaagagatgaaatgttttttcatatttaaataaataagaacatt

SEQ ID NO: 5993 - DNA, 3702 bp, Homo sapiens
gggccgccaccaaggcctgcgcgaccctccgcggggctggggagctgggcggggagcccggggcctgccaggcccgggctgcagccgcgtctgatcgccgagcgcgccgcgtagacctccgctcccccaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatgtacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagccattttcccacatattatgtgtaaaatatctctaatattcaaagtcttacaaatggaacaagagggaaggtaccagatttgtggctttaaagaatgcaagagtaggtcaggtgaggtggctcatgcttgtaatgtcggcacttttggaggccaaagtgggaggatcgcttgaggccaagagtttgaaactagcctgggcaatatagtgagacctccatctctacaaaaaatgttattccttggtccccaggtcctggggcagggcagggacttggggctctcctctcaggccctggaggctcggagggaggcacttctgctgaggccctgcttataggaaagctcagtatcctggcacctccatgtgtgtaaggacgtcagggtgaattataacccatggtgattaaggaagggccgagcctttctcttgcagagcgattgctcttctgctggcctcgtctagcacaaatcaggtgccctagcacaggccacactcctggagttaatgaagccactttaatcatttatatgccacttaagttgatgggggacagggcaggggtgggaaggaggggttgtctgtctgtgaaaactgagtgtggcttttcttgttgaactgatcattcctgctcttcctgcaaataagtcctgcatacggaccctggaactaaaaatggaaaatcagagcatgccccctcccaattttgtatagctttagtgggctctaaagttgcccgtttttagtgtgaaggaaaaaacgttgatttgcagatatcgtgagaatgaaacctcaacaaagatgtttggttcagtgcttcaaagttgggggacactttttccatgttgaacaaatgccaacttctccggttgcttacagcaaatccttctggaacaatcggggctgaaattgagttgcctttgttaggcgattgggccccattcattcttactcgtgcatcaggtcctggtctgtgtcaggcccaggggacacaggtggtcccagctcagaggcccagtgtccactgcagcccctcccacagcctgcccacccctactgcagggaaaaatgcccagggaggagatggtccaactcctgatcagttttgtgtccgatggagcaggccttgctgagtgaagacactggaactagctgggtcctggggtgacttggaggctttgggcctaaaagggcagcctgaacctggagtcttatctcccccaggagccgaaagcacttttcttgatttcccccaggaaatcaagcgctgcttctcagctcctgtggttttagtatttatatatctgtatcttctttgtagaaatttatttatttttgaataagtaatacctgcctggtacaaaatttaaaaggtacgggagggcgcaagctgcaagggaaggcctgctcctatgccgaccccagaggcagccactgttaccaatttcatgtgtattcctttaactctgttttaaagtaagtctctgaaaactgttcatttccttttgtcagtatttgttgctgaaaacctagaaaaacccagaaaatataatgaaataaaaactacaaatttcacaacccagaaaa

SEQ ID NO: 5994 - DNA, 452 bp, Homo sapiens
aggcctgcgcgaccctccgcggggctggggagctgggcggggagcccggggcctgccaggcccgggctgcagccgcgtctgatcgccgagcgcgccgcgtagacctccgctcccccaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcacgaggccctgcagcagcagctgctggccatgctggtga

SEQ ID NO: 5995 - DNA, 895 bp, Homo sapiens
caagagcaggcctggagacccgggagtgccttggggagagggtccccgccctgccgggagcccggccctcccggtgccggggtggacactgttagtgtagtcattgtccctatggagaaactgaggcatggagaggctgaagtcacacaagcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccg

SEQ ID NO: 5996 - DNA, 1124 bp, Homo sapiens
gtgaacccggaaggtggcgcggccaccagtaacatgatctctagactgggacggtggggttcctgccggctgtattcgggccttggactggactgagaagctacggtggagaccatccatggaaaagaacccccctgatgatacgggccccgtgcacgtgcctttggggcatattgtggccaatgagaaatggcgcgggtcacagctggcgcaggagatgcaagggaaaattaagctcattttcgaggatggcttgacaccagacttttatctgtcgaacagatgctgcattctttatgtcaccgaagctgatttggtggcaggaaatggctacagaaagaggcttgttcgggttagaaattccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggttcaagagcaaaccaaagagcccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcctgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctc

SEQ ID NO: 5997 - DNA, 2298 bp, Homo sapiens
ggaaggtggcgcggccaccagtaacatgatctctagactgggacggtggggttcctgccggctgtattcgggccttggactggactgagaagctacggtggagaccatccatggaaaagaacccccctgatgatacgggccccgtgcacgtgcctttggggcatattgtggccaatgagaaatggcgcgggtcacagctggcgcaggagatgcaagggaaaattaagctcattttcgaggatggcttgacaccagacttttatctgtcgaacagatgctgcattctttatgtcaccgaagctgatttggtggcaggaaatggctacagaaagaggcttgttcgggttagaaattccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggttcaagagcaaaccaaagagcccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcctgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctcaaagaaaacaacaaaaaaaaaaaaaaaagaaaaaggattttctccagcagcaaccagtgaaagatgaggcgaggcttgaatggagcccgtgggtcgtcctgccttagcgtctgagttcagcttgtgaagttagtgggccgcagagggcactgccttcattctgctaagacgaaaagggctggtgggatcttcgcaagagagtcagggactcacactcagcaaaaagcattagggccgattttaatgtgcgaccttgacctgcatctgtcatggaaagtgccttctaaaaagcttcagtggtggatgtgaccatctgaaggaaacaaatgtacaaggaagcactgtgtatcctaagccctgggttcccagagtttcacctgctgttcatcaggtctggccttcatatacccgtactgcgagggctgtttccaatgtaaataaataactgcgcaacagttccttcctcctttcctttgttcctccctccccccggcctttttttttggcagatgtacagtttgtttataatcactgcatatgtcttctgcacacagaaagtatgaagtctgaagttcccacttaaagttgaaaactcaacggccgggcatagtggctcacacctgtaatcccagcactttgggaggccaaggggggtgaatcacaaggtcaggagatccagaccatcctggccgacatggtgaagccctgtctctactaaaaatacaaaaattagctgggtgtggtggcacacacctgtaatcccaactactcaggagactgaggcacgagaatcgcttgaacccaggaggtggaggttgcaatgggccgagattgcaccactgcactccagcctggatgacagagtgagactccatctcaaaaaaaaaaaaaaaaaatttaaagttgaaaactcaacatgcatgaggcagaacaggctgtgtttgtatatgaaaggcccaacaatggaaggatacaagaaaatgatggcagcagctgcatctagtgagggaagcaggggctggggatcaaaaggtacaaattgcccattcaaaaaatagacacaggccaggcacagtggctcacacctgtagtcccagcactttgggaggctgaggtgggaggattgcttgagtccaggatttcgagatcagcctgggcaacatggcaagaccccatctctac

SEQ ID NO: 5998 - DNA, 2608 bp, Homo sapiens
agcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcatgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcgcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcctggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcttggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcggc

SEQ ID NO: 5999 - DNA, 2708 bp, Homo sapiens
agcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcatgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcggttcttctatctctaccacttcgccttctatgcctatcactaccgcttcaatgggcagtatagcagcctggccctggtcacctcctggctcttcatccagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcctggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcttggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcggc

SEQ ID NO: 6000 - DNA, 789 bp, Homo sapiens
gggataacccgcggccgcgcctgcccgctcgcacccctctcccgcgcccggttctccctcgcagcacctcgaagtgcgcccctcgccctcctgctcgcgccccgccgccatggctgcctcccccgcgcggcctgctgtcctggccctgaccgggctggcgctgctcctgctcctgtgctggggcccaggtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaaagaagagttaaaacaacacatgtaaatgccttttgatatttcatgggaatgcctctcatttaaaaatagaaataaagcattttgttaaaaagaaaagtct

SEQ ID NO: 6001 - DNA, 5466 bp, Homo sapiens
gagccgcacggagctgcgggcagcgggcggactgttaaaccgcggcggcggcggcggcggcggcggcggcggcggcggcggcggcggccggggcgggagcggggcgcgctctggagacgagtcagcggcgccccgggtgggggaggcgggcgggcagctagagatcacctcagcagcccccaccacggccggaccgaaggtgcggcggcggaggggagccagggcgccccagcaggtttccaatacttatctacaggaatcgccatgaccccagctctgagggaggcaacagcaaagggtatcagcttttcatctttgccaagtaccatggagtctgacaagatgctctacatggaaagtcccagaactgtagatgaaaagctaaagggagacaccttttctcagatgcttggatttccaactcctgaacctactcttaatactaattttgtgaatttaaaacattttggctcccctcagtcttcaaaacattaccagactgtttttttaatgagatctaattctacattaaataaacacaatgagaattataaacaaaagaaattaggggagcccagttgcaataagctgaaaaacatactgtataatggcagcaacattcagctcagtaaaatctgtctttctcattctgaagagttcatcaaaaaggagcctctatcagataccacgagccagtgcatgaaagatgtacaaattattctggattcaaatataaccaaagacactaatgtagataaagtacaactacaaaactgtaaatggtatcaagagaatgcacttttggataaagttactgatgctgagattaaaaagggtttattgcactgtactcaaaagaaaattgtacctggccactcaaatgtgcctgttagttcttcagctgctgaaaaagaggaggaagtacatgctcgtttacttcattgtgtaagcaaacagaaaattttacttagccaggctagaagaactcagaaacatttgcagatgctcctggcaaagcatgttgttaagcactatggtcagcagatgaaattgtctatgaaacatcaactccccaaaatgaagacatttcatgaacctaccacaattttgggtaatagtttacctaaatgcactgaaattaagccagaagttaacacattgactgcagagaataaattgtgggatgatgcaaaaaatggctttgcacggtgtacagctgcggaaatccaaagatttgcattttctgctacagggctgttgtctcatgttgaagagggtttggattccgatgcaactgatagcagctctgatgacgatttggatgaatatacccttagaaaaaatgtggcagttaactgtagtactgaatggaagtggcttgtagacagagcacgagttggcagccgatggacttggcttcaagctcagatttcagacctagaatgcaaaatccaacaactaacagacattcacaggcaaattcgtgcctccaaggggatagtggtcctagaagaatgtcagcttccaaaagatattttgaaaaaacaaatgcaatttgcagaccaagcagcttcactaaacattctagggaatcctcaggttccccaggagtgtcaagatcctgtaccggaacaagattttgaaatgtcaccaagcagccctactttacttcttcgaaacatcgaaaaacagagtgcacagttgactgagatcatcaacagtttgattgcccctctcaacttgtccccaacttcatcacccctctcttccaaatcctgtagccataaatgtctggctaatggcatttacaggagtgcatcagagaatttagatgagctgtcttcctccagtagctggttacttaaccagaagcacagtaagaaaaagagaaaagacaggacaagactgaaatcttcatccttgactttcatgagtacatcagcccgaacaaggccacttcagagtttccacaaacgaaaactgtacagattgagccctactttttattggactccacagactttgccttcaaaagaaacagcatttttaaacactacacaaatgccttgcctgcaatcagcttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctgtacatagtactctgaatcaatggagaaatggatattcacctatatgtaagcctcaaataaggtcagaatcttctgcacaactgttacagggaagaaagaaaagacatttgagtgaaacagcattaggagaaagaactaaacttgaagaatctgattttcaacacacagaatcaggatcccatagcaattttactgctgtttccaatgtcaacgttttatcaagaatccagaattcatcacgaaatactgcacgacggagattgagaagtgagagctcttatgacatagataacattgtgattcccatgtcattagtagccccagctaaattagagaaactccaatataaggaaatacttactccaagctggaggatggttgttcttcagcctttggatgaatataatttaggcaaagaagagatagaagatctttctgatgaagtcttctccctaaggcacaaaaaatatgaagagagagagcaagccaggtggtcactatgggagcaaagcaagtggcacagaagaaacagcagagcttacagtaaaaatgttgaaggacaggacttgcttttgaaagaataccctaataacttcagtagcagtcagcaatgtgctgctgcaagtcctcctgggcttccttcagagaaccaggatctgtgtgcatatggcttaccttctttaaatcaaagtcaagaaaccaagtctttgtggtgggaacgacgggcttttccactgaagggtgaagacatggcagccttattatgtcaagatgaaaaaaaggatcaggttgaaaggtcaagcacagctttccatggtgaaatcttcggtaccagtgtaccagagaatggccaccatccaaaaaagcagtcagatggaatggaagaatacaaaacctttggtctaggacttactaatgttaaaaaaaataggtgacagggaacaggttaagaaaactatgtaaatgtaggaaagatgggaggaaataaagccctgttctggatcccccatcccctccagaataagagcatgttctgcatgtattaatcttttatgctgtttatgaaacaggcaagataagtctgtttttccttctggaaccataagggtaaccagattttcatctacagacaagtggtagtcatttgtgtttatcatgcaacttacttacaaacaccaagatattaattgctgcaacttgatgtcaaatcacattactgggtaatttttaagactatgtacccacaccatacatacatacatatatatatacacatacatacaaacctgtgtgccaagtgacagctatttttttatatacatggtaattcattaaaattgccttagtaatatattagaatatacaaatatgtgtgtataaaataaacatacacacacacacacacccctatgtagtttttaaaacactggcaatgacccactccccttggaaatgcatgtatgaactaccctatgaaatgtaagctgcagaatagataaaacacaggtttccactaataaaagacatctgaacgtcctgaatatagagacagaagttttttgttgttgttgttgttgttttaacatgtttaaccaacagaagttatttacagaaattcatatatccaggcaacacaaaactcctttattcaaaatcactgctatctttgggactaaacacaggctactttctgtttactcctaacaaaataaagcaagcaaatttgagtcaaatattggtgcactttaatactatcacatctttgaaaactcaatttgagttttaccaattaatgtgtctcatgaagagaagacaccagttttaaaatgagccacaaacagtaaagccctatcagtataaaatttgaaaaaaaaaaaaaagatgattgtatttctagattagcaagaaattagttaattctggctgatttctatttctagctaatttggtcattctttgccatagcttactctattcaaataaacatatattcttgcttgcatcctagattggaaattaaaatttttcaaagaacaaagcttcaatattggatactgaagagtatacatgaaagaaaattccttttgaagctattaaaccatttttttcctatgtgaaagttgaggacaatttatataactcactttttgtcatgtaaaaaaggttactcaagttgtactacccacataactgaaaatattggccatttggccttatctgtgagatttgacactaagtttttgttagagattggaaattatactagtccttttaaggggtaaaaaattcaattcaatactgacaaacttttgcttgtagttttactgtacatttatttttaaagaaaaagaaaacaaaagccagacaaacccaagttgtccaggcaaataaactcaaatctttgtcacgtctgatattataatcttctatgtaagttttttaattaaagttatttctatatgccgtgtgttgcttgttattaaatgcgacgtattcatggcacaaagctttcccaagctgaataaaaacaaacattaacaaatttttaccttgtaatgcaggaagaaacccaagcaagctctagtctgtgcttaagtgttagcattcttattttttgaaccttatttctcaaaacttatagtagcctcaagaagtctattgatattggtcatgtttatttcttgccatatttataacacagcaagagtatttacaggaatgaagtagctgacacatatttttagactctgtataattcagaacagttataaatatttagtttatggattgactctgtatcctgtcatcttttcgcctacctgatctttcttggaataaaataatatatccttggggtcaagatccatagttccagaattttctcagccatctggttctgctacagcgtaaaattagactggaaataagacaacgttaagtaaaaagcttcttttacctaacccacctcccaagggctccatttgtaaaagtacagaccagaaattctaccacttcccagatcctttccagggtaccaccctattaagcattaatttcttcattttttaaatggggacaaaaatatctgctttattattaccacttacttatagaggtgatttacagatttaatgagaatatatcaaagtactttataactcacaaaaatataa

SEQ ID NO: 6002 - DNA, 1566 bp, Homo sapiens
ccgcctccgccgcggcccccacctctgcctccttctactcgggcgccccggcggccgccacctctccccagcccaggagaggctgcggagccgcagccgcccagaccgcgcagcgcgggaggcaggttccgcacgaaataaatcagaatgagttatgcagaaaaacccgatgaaatcacgaaagatgagtggatggaaaagctcaataacttgcatgtccagagagcagacatgaaccgcctcatcatgaactacctggtcacagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaagaatgaccaaaa

SEQ ID NO: 6003 - DNA, 1196 bp, Homo sapiens
cttctactcgggcgccccggcggccgccacctctccccagcccaggagaggctgcggagccgcagccgcccagaccgcgcagcgcgggaggcaggttccgcacgaaataaatcagaatgagttatgcagaaaaacccgatgaaatcacgaaagatgagtggatggaaaagctcaataacttgcatgtccagagagcagacatgaaccgcctcatcatgaactacctggtcacagagggctttaaggaagcagcggagaagtttcgaatggaatctggaatcgaacctagtgtggatctggaaacacttgatgaacgaatcaagatccgggagatgatactgaaaggtcagattcagcaggtggtgcacgactgttggcggaaggaacgcgtgttcatcctcagtgatctgccctccagcatctcggcagcatctcatcctccatcgtcagctggctctgccgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgacccatccaagggcgtcctttggagccagtggagcctgccggcgcatctgaggggcagaatgctgctagcacttgaatctgggatctcgccttattctcaagtagcaaggcatctcgacaagcatggtctaggtctggtggccagcttgccagtacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctctacttctctttccagtgggtaggagcttttggcagtgtttactttacctagatggcttatataatccagtaagagatgcaaagataaaattgctgcggttgttacagaagcatggcggcctccagactgacccattggttgccctttagattttgtaaggatgcggtgctggggaggtggtgcttccctacccc

SEQ ID NO: 6004 - DNA, 6869 bp, Homo sapiens
gccgccctgcgggcaactgagaccctcgcagctgcaccgtcctcctccgccgccagtcgtccgccgccatggacgtgtaccccccgcgccggcaggggctgccccgcgctcggtcccctggcggctccagccgcgggtcaccctccgtcagctgcagtcgacttcggcaggttcagagcatcctgacccagagcagcaagtctcggccggatgggatcctctgcatcctaggaatcgatagcaggtacaatgaaggctgcagagagctggcaaattatcttctatttggtttgtacaatcagaataccagtgattttgagaaaacgggattttctgaagaagtactagatgatgtaattatattgattaaatcggatagcgtccatctgtactgtaatcctgtaaactttcgctatctcttaccttatgtggcacattggagaaatctgcatttccactgcatgaccgaaaatgagtatgaagatgaagaagccgcagaagaatttaaaattaccagctttgtggacatggttcgagactgtagtagaattggcattccttacagctcccaaggtcacttgcagatatttgatatgtttgtggtggagaaatggccaattgtacaggcctttgcacttgagggcattggaggggatggattttttaccatgaaatatgagttgcaggatgtgagtttgaatctatggaatgtctacagcaagatggatcctatgtctctggagagtttgctttcagatgatttggtggcttttgaacatcagtggactagcttcttcgctaattttgacacagaaattcctttcctgctagaactttcagaatctcaggcgggtgagccattcagaagttatttcagtcatggaatgatctctagccatataactgaaaacagccctaaccggcagccatttgttctctttggtaatcactccacacgagaaaacctgaatgctggcaactttaacttcccttctgaaggacatctggtacgaagcactggtcccggcgggagctttgccaagcacatggtagcccagtgtgtctcaccaaagggacctcttgcttgttcgagaacatacttttttggagctactcatgttccttacttgggtggtgacagcaagctgcccaagaaaactgaacaaattaggctattgtcccagatatatgctgctgttattgaggctgttttggctggcattgcatgttatgctaaaacttccagtctaacaaaggccaaggaggtagcagagcaaactctgggatctgggttagattcctttgagttgattccgtttaaggcagccctgcgctccaagatgacttttcatatacatgctgtgaataatcagggaagaattgtaccgctggacagtgaagatagcttatcctttgtgaagacggcttgtatggccgtctatgacattcctgacttactgggaggcaatggttgtttaggatctgtggttttctctgaatcatttttgacttctcagatcttagttaaagaaaaggatggcactgttaccacagaaaccagctccgtagtcctgactgctgctgtacccagattctgctcctggctggtggaagataatgaagtaaaattgtctgagaaaacccagcaagcagtgaggggggatgagtctttcctgggcacttatctaacaggaggagaaggagcatatctttattccagcaatctacagtcctggcctgaggaagggaatgttcatttcttctctagtggccttctgttttctcactgtcgtcatagaagtatcatcatttccaaggatcacatgaattccatttccttctatgatggggattccaccagtactgttgctgctcttctcatagacttcaaaagctcattgcttcctcacctcccagttcatttccatggatcaagcaattttctgatgattgcccttttccccaaatcgaagatataccaagcattttactcagaggtcttctccctctggaaacagcaggataactcagggatctctttaaaagtgatccaggaagatggattatctgtggaacaaaagagattgcactccagtgcacagaagctcttcagtgccctgagccagcctgctggggagaaacggagttccctaaagttactctcagccaaactcccagagctggactggtttctccagcatttcgccatcagcagcattagccaggagcctgtgatgcggacccatcttcctgtgctgctgcagcaagctgaaatcaacactactcacagaatagaaagtgacaaggtaattatcagcattgtaaccggcctcccaggctgtcacgctagcgagctctgtgcttttctggtcactctgcataaggaatgtggcagatggatggtgtatcgccaaatcatggacagctctgaatgttttcatgctgcacacttccagagatacctttccagtgccctagaggcccagcagaaccgctctgcgcgccagtcagcctacatccgcaagaagaccagactgctggtggtgttacaaggctacacagatgttattgatgttgtccaggccctgcagacccacccagactcaaatgtcaaggcctccttcaccattggtgccatcacagcatgtgtggagcccatgagctgctacatggagcacagatttctctttcctaaatgtcttgaccagtgttcacaaggcctggtgagtaacgtggtattcaccagtcacaccacggagcagcggcaccctctccttgttcagctgcagagcctcatcagggctgccaatcctgctgcagccttcattcttgcagaaaatgggattgtcaccaggaatgaagacattgagctgattctctcagaaaacagtttttcaagtcctgagatgctacgatctcgatatttaatgtatcctggctggtatgaaggtaaattgaatgctggatcagtctatcccctaatggttcagatctgcgtatggtttggccgtcccttggagaagactcgctttgtggccaaatgtaaagcaattcagtcctccatcaagccaagtcccttctccggaaacatctaccacatcctgggcaaagtgaagttttcagactctgagaggaccatggaggtctgctacaacacactggccaactccttgagcatcatgccagttttggaaggacccacaccaccaccagactccaaaagcgtatctcaagacagcagcgggcagcaggagtgctaccttgtgttcatcggctgctccctgaaggaagacagcatcaaggactggctgcggcagtcagctaagcagaagcctcagaggaaagccctgaagaccagggggatgctgacgcaacaggagatcaggagcatccacgtaaaacgccacttggaacccctacctgcaggctacttttataatggcacccaatttgttaacttctttggtgacaaaactgattttcacccactcatggaccagttcatgaatgactacgtggaagaagccaaccgggaaattgagaagtataaccaggagctggaacagcaggagtatcatgacctctttgagctgaagccctagaggaaggctgggcccgtacgtcctgcagaatgtccaccttggagatggacgaacgggtgtcttaacctcagctctgctggaggcctctcccttaaggggctgtctttgttctccttggcctgtgtgggctggcttgagtgcatgttgtctttattccctgtatagcgctgaagagcatcacctgcaccattgattttgggggtcgggggaatactcaaggatgagcagatggggcctgcccgtctacgtgtgcaactggcagtccaggagctctgggtttctgataacaggatctcctttgggctcttgaggttggggagaagcattaggattacacagaggagctactgggacttagaaggaaccctggctgcctgaactgtggccgtgtctgggaggcgaggccacgacaggcctcaagcctcagatgctgctccacgagagccatcttccccagtggagtgcctgcctcccctgctaggcccgtttccctgaaggagctggccgtactggccgtgggcccagtcctgggaggagcagcacagccttgcccaggcccagtccacagagccagcagcttgggttgagatgaatgatgtgttcacaaatgaggggatttcccttctggactaaactgaaggagaggcttgttgctttccagaggtgtgtggctcttaagttgacatcagcttttccccttgtgggtggttctttagctctcctgtcacaccattcgggtgtcctaatgtagggacaagagcaagcctgctgctcaggccccctggcgaggcttcacctcactgtggaagggggcgtcctgcagctggttagtcttaggcctggtggctgatcacttgtggggtcagtctccagcacccagcgctcccacaagccttgccaaggaaggcctgcttttcagccacaaacttcaggaaactcatccccccgctccccaaagtgttgttgctggccctgggcttgtgtggctcctgaggattgggaatttcaaataattgcaatacctgagttagaattccttctaatggcatcgttttaagctggaccataaagcagaggggaattacaagtgtgtcccatgcctgaccttcataattggtgtgggggacaggggagtcacagccactgatatttaggtgatgtctcttaggacttcagtgcctcagctgcctgaactgtaaatgttttctgaatttcacatatttttttttgcatgccttaggaagaagcacataggtaaaaccagcagtttccagtaatatagggggtttttgagcaaggcccctggagcagcggagagacaagatggagcacatgtagtctgtgtgcctggtcacacagaggcctgcatgcaagtagcaaagcagctctcaagggcttgtcagtaaaatatattagaaaaaaaaaaaaaacaatttgaagccaaatgaacaaaactccagataccattgataagaaattttgcatcaagaagggcttctgaaaagacccacgtgctccagtcccagctccaaaagccactgatgacaagggccccactgtggaacctaagtctgggagccccctgacttctggctggccagaggctgcggtccgtcaagggcttgcctcgcttcagaatcagtaacatagatcttaagtgcaattgattaataagcagtgagttactgtagcttcctttagctctaccgaactctttttaaaaactcaaacttgagcagccttagaaaaggggttggggggtgggaaccacaggccatttctctaagtgggctgctgtgaagttttaaatgaaagctctagctttaggagcttgagccatttcctgactgcactggcctggcagtctggctgctgcagaagagtttttaaagaggggtcggagcccgcccgtgagagcgggtcttctcaccatgtggggctgtactacgtggtggtctttgtttctcttcacagaaatgctctctcaccaacttgccccactgtcccaactcctctcctcttagagaaaaaactgtgattacctcaacttgaatatgaaactgtgattgaaaaaagtcaaaacgtgaagaagcatcaaagccaaaaaggcaaaactggctgaggcctctgttgatgctcctcagcctactcgggaacgtgaaggggcagctggcgaaagggcattcctggggccacttgctctgccccactgataaggcacacccgcggtgcactgtgagctctttgaggactgaggccaggggatgcctcctggaacctgccaggcctctctgttctgtgaaggtcagtatccacttgattcctccaggcggcgctccaggtgggaggagcagggtcttctgctgtttccaaaggaatggccatgacactgcttttgaccttagaagtggatccagggacccagcaaagagcgggggtgggttcccagggacaggcagtcctcccggggcttacatgctttttgctaactttcctattagcagcttcagtttatatcacccagagtgcgtgggataatgttgaagtcgctgaagttacgggttattttatgtttttacatgggatttttctgtttttgattggaagaaggagacagaaattggaggaaatgggattattatcctagggaagggccgttggcaaggagttgagccggcccctctgagccctgggggctatctgacctgaagcctggacactgggcccttcaggtcgcaagaaaaagttccctcctaaattctattaggattttggagaatttttgcacagtaagaagctctgggttgctccttgggcttctcaaaagggaaaagttcaattcaaagattgtaaactacgaagtattccagccgtgttgctgatctagttggatagttgtacctcaaaaaagtaggtgagaactggcttcctcattgtcccaggatgtcaaatactaatgacataagagctcacttacgtgccaaaattcacttttatactagtttttcagtgctttaatatttgtaacttaaattttaaaactcgtatttacaaacactactgtaacttcagtgaaactgaattgtgcgattgaagctttttgcttatcatagtatttattacactacttaattcagtaaatatataaaagtagccttcaatttatttttatattattttacatgtttttacctgcagttgtgtatgtgaatttaccttggtaatcgagatgtcatgctaaggaccaataaactatcactgaacaag

SEQ ID NO: 6005 - DNA, 3111 bp, Homo sapiens
ataccggagttttgctctatcactgtatcatggacagcaagcttatggaacttattcctcaaaaagtgggacatgctgaaaatacaaacctagcttgagtttagttatgtccctaaatgttaactgatccctgtgggtcagtagggagacagctggcatccgtttccaaccagccaaggatattcggtcgactgtactgactgaccactttgctcaggccgcaagtgtccctcagaaaagcctgaggacttattaaggtcatggaaggttgccttggccaggaactcttttctaatcacatgtttttgacttccctctctagccctaaccggcagccatttgttctctttggtaatcactccacacgagaaaacctgaatgctggcaactttaacttcccttctgaaggacatctggtacgaagcactggtcccggcgggagctttgccaagcacatggtagcccagtgtgtctcaccaaagggacctcttgcttgttcgagaacatacttttttggagctactcatgttccttacttgggtggtgacagcaagctgcccaagaaaactgaacaaatgctattgtcccagatatatgctgctgttattgaggctgttttggctggcattgcatgttatgctaaaacttccagtctaacaaaggccaaggaggtagcagagcaaactctgggatctgggttagattcctttgagttgattccgtttaaggcagccctgcgctccaagatgacttttcatatacatgctgtgaataatcagggaagaattgtaccgctggacagtgaagatagcttatcctttgtgaagacggcttgtatggccgtctatgacattcctgacttactgggaggcaatggttgtttaggatctgtggttttctctgaatcatttttgacttctcagatcttagttaaagaaaaggatggcactgttaccacagaaaccagctccgtagtcctgactgctgctgtacccagattctgctcctggctggtggaagataatgaagtaaaattgtctgagaaaacccagcaagcagtgaggggggatgagtctttcctgggcacttatctaacaggaggagaaggagcatatctttattccagcaatctacagtcctggcctgaggaagggaatgttcatttcttctctagtggccttctgttttctcactgtcgtcatagaagtatcatcatttccaaggatcacatgaattccatttccttctatgatggggattccaccagtactgttgctgctcttctcatagacttcaaaagctcattgcttcctcacctcccagttcatttccatggatcaagcaattttctgatgattgcccttttccccaaatcgaagatataccaagcattttactcagaggtcttctccctctggaaacagcaggataactcagggatctctttaaaagtgatccaggaagatggattatctgtggaacaaaagagattgcactccagtgcacagaagctcttcagtgccctgagccagcctgctggggagaaacggagttccctaaagttactctcagccaaactcccagagctggactggtttctccagcatttcgccatcagcagcattagccaggagcctgtgatgcggacccatcttcctgtgctgctgcagcaagctgaaatcaacactactcacagaatagaaagtgacaagatggatggtgtatcgccaaatcatggacagctctgaatgttttcatgctgcacacttccagagatacctttccagtgccctagaggcccagcagaaccgctctgcgcgccagtcagcctacatccgcaagaagaccagactgctggtggtgttacaaggctacacagatgttattgatgttgtccaggccctgcagacccacccagactcaaatgtcaaggcctccttcaccattggtgccatcacagcatgtgtggagcccatgagctgctacatggagcacagatttctctttcctaaatgtcttgaccagtgttcacaaggcctggtgagtaacgtggtattcaccagtcacaccacggagcagcggcaccctctccttgttcagctgcagagcctcatcagggctgccaatcctgctgcagccttcattcttgcagaaaatgggattgtcaccaggaatgaagacattgagctgattctctcagaaaacagtttttcaagtcctgagatgctacgatctcgatatttaatgtatcctggctggtatgaaggtaaattgaatgctggatcagtctatcccctaatggttcagatctgcgtatggtttggccgtcccttggagaagactcgctttgtggccaaatgtaaagcaattcagtcctccatcaagccaagtcccttctccggaaacatctaccacatcctgggcaaagtgaagttttcagactctgagaggaccatggaggtctgctacaacacactggccaactccttgagcatcatgccagttttggaaggacccacaccaccaccagactccaaaagcgtatctcaagacagcagcgggcagcaggagtgctaccttgtgttcatcggctgctccctgaaggaagacagcatcaaggactggctgcggcagtcagctaagcagaagcctcagaggaaagccctgaagaccagggggatgctgacgcaacaggagatcaggagcatccacgtaaaacgccacttggaacccctacctgcaggctacttttataatggcacccaatttgttaacttctttggtgacaaaactgattttcacccactcatggaccagttcatgaatgactacgtggaagaagccaaccgggaaattgagaagtataaccaggagctggaacagcaggagtatcatgacctctttgagctgaagccctagaggaaggctgggcccgtacgtcctgcagaatgtccaccttggagatggacgaacgggtgtcttaacctcagctctgctggaggcctctcccttaaggggctgtctttgttctccttggcctgtgtgggctggcttgagtgcatgttgtctttattccctgtatagcgctgaagagcatcacctgcaccattg

SEQ ID NO: 6006 - DNA, 1636 bp, Homo sapiens
agtgcgcctgcgcggagctcgtggccgcgcctgctcccgccgggggctccttgctcggccgggccgcggccatgggagaggccgaggtgggcggcgggggcgccgcaggcgacaagggcccgggggaggcggccaccagcccggcggaggagacagtggtgtggagccccgaggtggaggtgtgcctcttccacgccatgctgggccacaagcccgtcggtgtgaaccgacacttccacatgatttgtattcgggacaagttcagccagaacatcgggcggcaggtcccatccaaggtcatctgggaccatctgagcaccatgtacgacatgcaggcgctgcatgagtctgagattcttccattcccgaatccagagaggaacttcgtccttccagaagagatcattcaggaggtccgagaaggaaaagtgatgatagaagaggagatgaaagaggagatgaaggaagacgtggacccccacaatggggctgacgatgttttttcatcttcagggagtttggggaaagcatcagaaaaatccagcaaagacaaagagaagaactcctcagacttggggtgcaaagaaggcgcagacaagcggaagcgcagccgggtcaccgacaaagtcctgaccgcaaacagcaacccttccagtcccagtgctgccaagcggcgccgcacgtagaccctcagccctggtggcggcagagaagcgggcgaggcactgtggtcgctgagggggttggctgggtctgagtgccaccccccaggccacagtgataccatcccagtgccatgagcccacactgcccgccctcaggctctcaggtgaacgtggccgtcagcggggaaacgtgtgtgtcagttggaccatgtgggaccctgatggacctgaaagaccaggatcggtccagctcagatattgagggctctgaagcctagttctgtcttctctggagcagctgtggcttccccgtggctgcttggtgacatggattagcgctacgtgggctgcagcatttgggatccaggctacctagaggggcatcgggccagggaaaacctcggattagcaagcaataaaaacatgacctcactcttcctcaaaggagcccctggtcttccctgtgtgactcagttctttccatctgtttgtcccgctgcaagcctctttctgcgctgactgtgacattggaacgtggccttcctgtcaccccctccgtgccacgcactgaaggccacccccacccacctgggaaactaagaactggatattttgcctcattcacttgtactgtaacaatgtatataatttggttggtatttcactatttaatttttaagaagcctattttactagtgttttatatgaacaaagtactgcagaagttaaacctgtgttgtattttttctgagatgttttgctttaagagatactttttgctcagtttttatatgccagatacagagaatttgtagcggttatttttgtatgatctagtaacttgcaaacagaccaaatggatgagaggcggggaccgtgcagctgtcggctgatgaggaggcggccgccccagtgctgatggagatgccactttcgtgtgactgcgaacattaaagcacaaaaaaatccaa

SEQ ID NO: 6007 - DNA, 2598 bp, Homo sapiens
actagaaggaagaagtatggagttaaagactgcagcgtgaactgaggagtcccggacaggccgcttgctgcagaggatccagtccagatcccaggagagcccctctgccccttcggacctcgtctcccatctacaaaacgtgaagattggcccagttagcgtgtctctacaaaaaggtgcatataccactgccccgctgcaggctgatctgagaaagcctctggcccagggcagataccgccatggccttcctgatgcacctgctggtctgcgtcttcggaatgggctcctgggtgaccatcaatgggctctgggtagagctgcccctgctggtgatggagctgcccgagggctggtacctgccctcctacctcacggtggtcatccagctggccaacatcgggcccctcctggtcaccctgctccatcacttccggcccagctgcctttccgaagtgcccatcatcttcaccctgctgggcgtgggaaccgtcacctgcatcatctttgccttcctctggaatatgacctcctgggtgctggacggccaccacagcatcgccttcttggtcctcaccttcttcctggccctggtggactgcacctcttcagtgaccttcctgccgttcatgagccggctgcccacctactacctcaccaccttctttgtgggtgaaggactcagcggcctcttgcccgccctggtggctcttgcccagggctccggtctcactacctgcgtcaatgtcactgagatatcagacagcgtaccaagccctgtacccacgagggagactgacatcgcacagggagttcccagagctttggtgtccgccctccccggaatggaagcacccttgtcccacctggagagccgctaccttcccgcccacttctcacccctggtcttcttcctcctcctatccatcatgatggcctgctgcctcgtggcgttctttgtcctccagcgtcaacccaggtgctgggaggcttccgtggaagacctcctcaatgaccaggtcaccctccactccatccggccgcgggaagagaatgacttgggccctgcaggcacggtggacagcagccagggccaggggtatctagaggagaaagcagccccctgctgcccggcgcacctggccttcatctataccctggtggccttcgtcaacgcgctcaccaacggcatgctgccctctgtgcagacctactcctgcctgtcctatgggccagttgcctaccacctggctgccaccctcagcattgtggccaaccctcttgcctcgttggtctccatgttcctgcctaacaggtctctgctgttcctgggggtcctctccgtgcttgggacctgctttgggggctacaacatggccatggcggtgatgagcccctgccccctcttgcagggccactggggtggggaagtcctcattgtggcctcgtgggtgcttttcagcggctgcctcagttacgtcaaggtgatgctgggcgtggtcctgcgcgacctcagccgcagcgccctcttgtggtgcggggcggcggtgcagctgggctcgctgctcggagcgctgctcatgttccctctggtcaacgtgctgcggctcttctcgtccgcggacttctgcaatctgcactgtccagcctaggcaggccgccgaccccgcccccatcgctcacggacggaactggggtccagagaggccaggtcacagagcaaggggcaggaacagagagacagagcctgagtaattgaatcatgaacgcaagtgcccactggggactgtggggaagatggcacctggaaatgcaaggtgcggctctatccccaactctgtgtcacactacctgtgacgaccagctcagatctcctttgctttgactctcaagagaggactgatttgcagcatctagctggaggcaggcccaagggtgttagaagggaaacagctgggacagccggctgtcccttcaggctgtgtgaccttgggaaagtcatttggcttctctgtgcctgtttcttcatgcatgcagtggggattccagtaagtaccaactacctcacaggcatggcacggaggcaaaaggaaaaagcagcccgcatcaagcaagccctcctgggccacctgctgatctgacagtccatcgtagtaacaagagtggcagtctgcacaacctagaagtggccagaagggttgagacacgcccctgccctctctcctttgcccctcagtctcacagaggggcttctacaagacaagcagataacgatagaatcttgggcatcttggctttcggattctcagtgtggagggacgtagtaccccacacaccccttcctgtcatccttcctggcccataaagcccactagttggagagtaagtaccctcctggaagccgggagagatgatttgctggtggggctggggaaggcccatccctgagcctctgaaagtgaactccccgaccaggttggggaccagacatgcagagcccctggaagtattctctcaaatggaggcaacagaggtgattgttattttgttttagtttctgtttttcatttttttaaataaaggcattccctgctttta

SEQ ID NO: 6008 - DNA, 3060 bp, Homo sapiens
actagaaggaagaagtatggagttaaagactgcagcgtgaactgaggagtcccggacaggccgcttgctgcagaggatccagtccagatcccaggagagcccctctgccccttcggacctcgtctcccatctacaaaacgtgaagattggcccagttagcgtgtctctacaaaaaggtgcatataccactgccccgctgcaggctgatctgagaaagcctctggcccagggcagataccgccatggccttcctgatgcacctgctggtctgcgtcttcggaatgggctcctgggtgaccatcaatgggctctgggtagagctgcccctgctggtgatggagctgcccgagggctggtacctgccctcctacctcacggtggtcatccagctggccaacatcgggcccctcctggtcaccctgctccatcacttccggcccagctgcctttccgaagtgcccatcatcttcaccctgctgggcgtgggaaccgtcacctgcatcatctttgccttcctctggaatatgacctcctgggtgctggacggccaccacagcatcgccttcttggtcctcaccttcttcctggccctggtggactgcacctcttcagtgaccttcctgccgttcatgagccggctgcccacctactacctcaccaccttctttgtgggtgaaggactcagcggcctcttgcccgccctggtggctcttgcccagggctccggtctcactacctgcgtcaatgtcactgagatatcagacagcgtaccaagccctgtacccacgagggagactgacatcgcacagggagttcccagagctttggtgtccgccctccccggaatggaagcacccttgtcccacctggagagccgctaccttcccgcccacttctcacccctggtcttcttcctcctcctatccatcatgatggcctgctgcctcgtggcgttctttgtcctccagcgtcaacccaggtgctgggaggcttccgtggaagacctcctcaatgaccaggtcaccctccactccatccggccgcgggaagagaatgacttgggccctgcaggcacggtggacagcagccagggccaggggtatctagaggagaaagcagccccctgctgcccggcgcacctggccttcatctataccctggtggccttcgtcaacgcgctcaccaacggcatgctgccctctgtgcagacctactcctgcctgtcctatgggccagttgcctaccacctggctgccaccctcagcattgtggccaaccctcttgcctcgttggtctccatgttcctgcctaacaggtctctgctgttcctgggggtcctctccgtgcttgggacctgctttgggggctacaacatggccatggcggtgatgagcccctgccccctcttgcagggccactggggtggggaagtcctcattgtgagtatccggccggtggggctgctcccgctgcgtacccctcacccctagccaaggcctgggagagcttgggcgcggccctttccagcgagcggggtctgtgggaccctcccgggaagccccaggtgggggaagcgccccttcctcatttgggagtggaggcttagggaatcgaggtgactggtaggcctcttcccaccatgtgtacctcagcaggggccttctctcaagggcccttgccctgatcatgggcacgtgaacccagaaaagccactggattctccttcgcccccgggcggccaactcatgggacccgtcggccccgcaggctcactcccagaaggcgctcctcgcacctagagagtattccgtgggttcccctgagccctgtgagagttctttgctccggcgctcgccccgcaagccccgtgactctgcacctcttccctcccggccccgcaggtggcctcgtgggtgcttttcagcggctgcctcagttacgtcaaggtgatgctgggcgtggtcctgcgcgacctcagccgcagcgccctcttgtggtgcggggcggcggtgcagctgggctcgctgctcggagcgctgctcatgttccctctggtcaacgtgctgcggctcttctcgtccgcggacttctgcaatctgcactgtccagcctaggcaggccgccgaccccgcccccatcgctcacggacggaactggggtccagagaggccaggtcacagagcaaggggcaggaacagagagacagagcctgagtaattgaatcatgaacgcaagtgcccactggggactgtggggaagatggcacctggaaatgcaaggtgcggctctatccccaactctgtgtcacactacctgtgacgaccagctcagatctcctttgctttgactctcaagagaggactgatttgcagcatctagctggaggcaggcccaagggtgttagaagggaaacagctgggacagccggctgtcccttcaggctgtgtgaccttgggaaagtcatttggcttctctgtgcctgtttcttcatgcatgcagtggggattccagtaagtaccaactacctcacaggcatggcacggaggcaaaaggaaaaagcagcccgcatcaagcaagccctcctgggccacctgctgatctgacagtccatcgtagtaacaagagtggcagtctgcacaacctagaagtggccagaagggttgagacacgcccctgccctctctcctttgcccctcagtctcacagaggggcttctacaagacaagcagataacgatagaatcttgggcatcttggctttcggattctcagtgtggagggacgtagtaccccacacaccccttcctgtcatccttcctggcccataaagcccactagttggagagtaagtaccctcctggaagccgggagagatgatttgctggtggggctggggaaggcccatccctgagcctctgaaagtgaactccccgaccaggttggggaccagacatgcagagcccctggaagtattctctcaaatggaggcaacagaggtgattgttattttgttttagtttctgtttttcatttttttaaataaaggcattccctgctttta

SEQ ID NO: 6009 - DNA, 2368 bp, Homo sapiens
ggcaagcgaactaggccaaactacttgcacgttccctcgagaagatctttggagtagacacaaaagccgcgctggcgcatgcgcacaaaaagcgccggcaattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaatgtcgtccagaattttcatcagaaatggatagctttaacatctaaaattattatattttgaagcaagaagcactctaagctatttactaataggcttttcatataattaggaaaacctaatatcacatctatagtaaccatttcagtttcatattgtttctgttctcataaggatactgctgagtgtctttgcagattcagcctaaaagcaaagaaaatatttccctaaaatatttgcaaataatgttcacatatgtaaatgccttggaaaatattactcatgctgaccttttacacctttttcatttgtcatactgttttctttgccttgaagaggaacagatgaatatgcaccttctccagagttatgtggttttagaatttagaagagcatgtatctttattaaatccctcctcaactctttttttttaaagcatctgaatttaaccttatttcttttttatctccatggtgtgggtgggaccaccatggttttacaccccaccctaccttagggaagaagaaaacattttaaagaataccagaagtagaatcacatgtaacagtctctgcacagtcatcagtttattgttaagctttcctttgtaatttcagggcttaagcactattatcctaatccaagttcacagtcctgttgttgtcgaggagggttcaaaatcatttggagataatcaagctcagacagcttaggataggtgagaagaacatagaggaagcagggagaaggctgagaagcaagcaggagtgagcgctaagtgttttgtttccagttagctgttcgctgtcttttccatttaacctgggcactgccctagcctcatcttcagccttcagtgatctataatagcatttccttctgtctcctctcagtctctcttctgccttccttccctcctttactgtattagcaacaagctgtccatgggtgggggctgtgtgttagcctgtacgtagcacatgggactttccacatagtagatattcagttacattttgaactaattatataacaaacttgccctttgaaagactaagttatagttaaaaaccaagatttgtaggagaaaaagaaattattgttcccttcagtttgaaaaatcatcgatatttgaaactgggatacgcttggtagcttttttgttttaacacaaagtaaacctgtgaagtagaa

SEQ ID NO: 6010 - DNA, 991 bp, Homo sapiens
attggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataagcttcagttattccattgcaggaaactattggaaagtttttccaagctgacattgcagaaaatgctttgtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaa

SEQ ID NO: 6011 - DNA, 2330 bp, Homo sapiens
aattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaagaacaaaagtccagaatgttgacctaattttacaaaacaagctgcatatcagctgatgaatgcatgagaaattttcaaggctttcacagtggtcttaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaatgtcgtccagaattttcatcagaaatggatagctttaacatctaaaattattatattttgaagcaagaagcactctaagctatttactaataggcttttcatataattaggaaaacctaatatcacatctatagtaaccatttcagtttcatattgtttctgttctcataaggatactgctgagtgtctttgcagattcagcctaaaagcaaagaaaatatttccctaaaatatttgcaaataatgttcacatatgtaaatgccttggaaaatattactcatgctgaccttttacacctttttcatttgtcatactgttttctttgccttgaagaggaacagatgaatatgcaccttctccagagttatgtggttttagaatttagaagagcatgtatctttattaaatccctcctcaactctttttttttaaagcatctgaatttaaccttatttcttttttatctccatggtgtgggtgggaccaccatggttttacaccccaccctaccttagggaagaagaaaacattttaaagaataccagaagtagaatcacatgtaacagtctctgcacagtcatcagtttattgttaagctttcctttgtaatttcagggtcctgttgttgtcgaggagggttcaaaatcatttggagataatcaagctcagacagcttaggataggtgagaagaacatagaggaagcagggagaaggctgagaagcaagcaggagtgagcgctaagtgttttgtttccagttagctgttcgctgtcttttccatttaacctgggcactgccctagcctcatcttcagccttcagtgatctataatagcatttccttctgtctcctctcagtctctcttctgccttccttccctcctttactgtattagcaacaagctgtccatgggtgggggctgtgtgttagcctgtacgtagcacatgggactttccacatagtagatattcagttacattttgaactaattatataacaaacttgccctttgaaagactaagttatagttaaaaaccaagatttgtaggagaaaaagaaattattgttcccttcagtttgaaaaatcatcgatatttgaaactgggatacgcttggtagcttttttgttttaacacaaagtaaacctgtgaagt

SEQ ID NO: 6012 - DNA, 2233 bp, Homo sapiens
atgagcaggagcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccagcggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacatctgccctgagctgctcagcaggcaggcagcagcctcccgcacccatgggagagagttttgttttcttggccgggctgggcaggtgcgccttcctttctctctcctgtgaagaactgcaggagggccctcagctgtgaggttgtggatgaacaggcctgttcgccctggggtccgggcctggcacaggaagcagctagactaggggagtccttggagcatctgagaggggttttctttcctctgggaagagtcgcaagtcttatgaggatgccacaatctgggcagtgacccgtggccctggggaccttcctagtgccccccaaaaccaaggaagcattcacgtgagatggggagtcagccttccagctggtgtgtaggaaagccaggtccctgggcccttgtcccatgtggggttgagatccagatctccatgagatattcccatcctccgccgagcggtgatgcgtgaccgtgtgtgcaggccgctgttctcccaagctcggggccatgccgtgccaccgtcaccagagccagctgcagcactggggcagccactgtcgccggacttggggaagcccagggtgaagacagtcactcatccgtgcaagctctccagaagggatgcaagctctccagaaggggtgtgatctctgagcagtggggagtggagtcaccactcgggacatagagggtggacagttcaggcctgtgtctgcctccttgggactgtggagtgggtgccctcagtaaagcgctttgttggaatggt

SEQ ID NO: 6013 - DNA, 1187 bp, Homo sapiens
gtcacccaggggccacagggcctccgagcatcaggccgctcgtgtgtggggccatttctgtcacatctcgggagggacaggaccccaggggtgttgaccgagctcaggtgcgtggtgcctgcacgcctgactgcactggagcggagcaggaagcctcgaggccgcggacgcggtcggtacatcacgctgctgcctgtgcctgaggcagaccccatcctggaaagagtcccacagccggagttttgctcttgtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccagcggcgcccaggatgaacgtggcctgaagccgccttcccggggccagtttccttccctctcagccagggatgcctcgagcagccacaggggcaggaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttg

SEQ ID NO: 6014 - DNA, 1634 bp, Homo sapiens
agcagagccaacgtgtcagcggcgcccaagcggccccagcgggctcgcgtcgccccgctctcctcaccgagccgccaatcggctcaggatccgcccctgacgacgcgggccccgcccctggagacacgcgccgcgcagtcgtcacccgcccgggatcaggaggccgggggcgcccgccggtcgggcctgggcggccgccatgaagctgacgcggaagatggttctgacccgggccaaggcctcggagctgcacagcgtgcgcaagctcaactgctggggcagccgcctcacagatatctccatttgccaggagatgcccagcctggaggtgatcacgctcagtgtcaacagcatctccaccctggagcctgtgagccggtgccagcgcctgagtgagctgtacctgcggaggaaccgcatccccagcctggctgagctcttctacctgaaggggctgccgcgtctgcgggtgctgtggctggccgagaacccgtgctgcggcaccagcccccaccgctaccgcatgaccgtgctgcgcaccctgccgcgcctacagaagctggacaaccaggctgtgacggaggaggagctgtcccgtgcactgagtgagggagaggagatcactgcggccccagagagagagggcacaggccacggcggccccaagctatgctgcacactgagctccctcagctccgctgctgagactggccgggacccgctggacagcgaggaggaggcaaccggcgcccaggatgaacgtggcctgaagccgccttcccggggccagtttccttccctctcagccagggatgcctcgagcagccacaggggcagggtgagtggcgggccgctaggggccgcggctgcctctgcccactgcacccactgcacagaaaccgtggggagggagcatggagcctcacagggccccgtggggagggagcatggagcctcacagggccttgaagagctgtgccccagggggagctgcgtgtgcgggtctgtgaatgcgcacacacgtgtaacacgtgccccgcacggagccgtcctggcccctcagcctctcctgctgtcctggtctgtggaatgtgggcccgggccctgctgggctgagggcaacaggagtcacgtggaagaggtgccacacacgcgtccacaggcggggctcctctgctcagattctccgagtgtgccgaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggtt

SEQ ID NO: 6015 - DNA, 1674 bp, Homo sapiens
caggcgcagtcccgacgagcaacgcgtttgtagaggggtgggtgcgcacgctctgtccctgcgtgaccttccgaccccgctgtcctcaccgcaatggcggctgtgagggtcctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctgagcacgtttgccgtggacgggaaagattgcaaggtgaataaagaagtggagcgtgtcctgaaggagttccaccaggccgggaagcccatcggcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagcccctcagcccccaggattgacctctggggagtgatggtagcgttggtgccaggccgtgggttcaggtgtggcagaagcttgcagatgcgtccgaagggaaataaagtgtgttggcgttagactttgtgctgca

SEQ ID NO: 6016 - DNA, 1506 bp, Homo sapiens
cccgctgtcctcaccgcaatggcggctgtgagggtcctggtggcctcgaggctcgctgcggcatctgcattcacgtccctgtcccccggcggtcggacgccttcccagcgcgcagcccttcacctctccgtgccgcgccccgcggccagggtcgcgctggtgctgtctggatgcggagtctacgatgggaccgagatccacgaggcctcggcgatcctggtgcacctgagccgtggaggggctgaagtccagatctttgctcctgacgtccctcagatgcacgtgattgaccacaccaaggggcagccgtccgaaggcgagagcaggaatgttttgaccgagtctgcgaggatcgcccgtggcaaaatcacagacctggccaacctcagtgcagccaaccatgatgctgccatctttccaggaggctttggagcggctaaaaacctcttgtgctgcattgcacctgtcctcgcggccaaggtgctcagaggcgtcgaggtgactgtgggccacgagcaggaggaaggtggcaagtggccttatgccgggaccgcagaggccatcaaggccctgggtgccaagcactgcgtgaaggaagtggtcgaagctcacgtggaccagaaaaacaaggtggtcacgaccccagccttcatgtgcgagacggcactccactacatccatgatgggatcggagccatggtgaggaaggtgctggaactcactggaaagtgacgcgcatggacggggcccagctaggcgccaggacttggcctcaccctctggctgaggagctgtcggctgctttccatccagctgggagtctggcaggcccttttttttttttctttgccgaaacctgcaggcgttctctctctaaggaggatgtgctgcagtgcatgggggatgtttcttcctgggtgtggctgggctgctctcacatacagaggccgaggggccaattcgttctctgccacagggacttgcctcactgtgtcccaaaaacaaatcgcagccagcttttccagaaatagaaaattctgccgtctgaggttttatacttcaggttagttagtttttggaaggaagaacatttttaggtttgcaagcctcctgatcaggaaaccagaaataccacatttatggaccatgaaaggttggttcttgactctgaagggacttttgagttaatcagcgtaaggggatttctaaagcaggcaatccctgtagccgcagagaataaacgccttcccaaaatggcaacttcccacagccacatttcagacctgctgagactgctgagtgaggaatggcagtgaggtttcttcaattagtctcagttctcttaattttcaggaagaaagggaaattgcagcccctcagcccccaggattgacctctggggagtgatggtagcgttggtgccaggccgtgggttcaggtgtggcagaagcttgcagatgcgtccgaagggaaataaagtgtgttggcgttagactttgtgctgca

SEQ ID NO: 6017 - DNA, 2303 bp, Homo sapiens
gtgctttctgccgtacgtcccttcccatgaggatgagatgacccatctgttgcatcccggctgctgataaaacaagaccctcggagccaagaaacaacactgaggctgatctccccgcccaggctggtctcccccgcaggctggtctcccccgcaagctggtctcctcccccaggctggtctcctcaccaggctggtctcctcccccaggctgatctccccgcccaggctggtctcccccgcaggctggtctcccccacaaggctggtctcctcccccaggctggtctcctcaccaggctggtctcctcccccaggctgatctccccgcccaggctggtctcccccgcaggctggtctcccccgcaagctggtctcccctgcaggctggtctcctccccaggctggtctcccccgcagactggtctcccccacaagctggtctccccaccaggctggtctcccccacatgctggtctcctcccactgcccttgccagtccctccctcctcaagtgtgggtgccaaggacggaccctgatgaacacctgcacatcagttgctgccctgggtgccagggtccacaggaagctgcactgggaaccctgtgtcctgggcaggtcctatgggaagtgcagcccacatgttactcgggtgaaggcagcgtccccacccagcttgaggacaccacacagggtggacacccgaccctggctgggccgctcaatggggagtggcttggacgcccctcttggagtacagtcgctacatcccgtagctgcctaatgtccttggcattctcgggccctggtcataatgtgggagtggctgcctgtgcacgccacgggcctccagcttcactgcctcaacggggccatgagccatcgcgggggcaggcagggtgctgggcacctcatcactagggcagtgacatcacaaggcgtggaaggcggtggtggctacggaactccgtgcctgggctgtttctgtggtgcctgcgggctctgggctcccacctccatggggctgcaggagccgtgagggacaaggagggacgcacccgccatggctgaaggcggcgagctgatgagccggctcctgagcgagaacgcggacctgaagaagcaggtgcgcctcctgaaggagaatcagatgctgcggcggctgctcagccagagctgccaggagggcggcggccacgacctgctcccacccagggcgcatgcctaccctgaggccggctcccccgggagcggagttccagatttcggaaggttcacgagtgttgccgacacgccctcccaactgcagacatcctccctggaggacctgctgtgctcacatgcccccctgtccagcgaggacgacacctccccgggctgtgcagccccctcccaggcacccttcaaggccttcctcagtcccccagagccacatagccaccgaggcaccgacaggaagctgtccccgctcctgagccccttgcaagactcactggtggacaagaccctgctggagcccagggagatggtccggcctaagaaggtgtgtttctcggagagcagcctgcccaccggggacaggaccaggaggagctactacctcaatgagatccagagcttcgcgggcgccgagaaggacgcgcgcgtggtgggcgagatcgccttccagctggaccgccgcatcctggcctacgtgttcccgggcgtgacgcggctctacggcttcacggtggccaacatccccgagaagatcgagcagacctccaccaagtctctggacggctccgtggacgagaggaagctgcgcgagctgacgcagcgctacctggccctgagcgcgcgcctggagaagctgggctacagccgcgacgtgcacccggcgttcagcgagttcctcatcaacacctacggaatcctgaagcagcggcccgacctgcgcgccaaccccctgcacagcagcccggccgcgctgcgcaagctggtcatcgacgtggtgccccccaagttcctgggcgactcgctgctgctgctcaactgcctgtgcgagctctccaaggaggacggcaagcccctcttcgcctggtgagccgccccgcgcccgccgccttgcctgcagtaaacgcgtttgttccaacccggggccgcggtgcctcctgcgcgtccccccggaggggaaagggccgcgtcccccgcgcgcgaggccagagaaggccccgctcccaccggtgctgggccccgaccgcagcccgccgctgcccgcacctgcggagtgcttctcacccctcattaaaatcatccgtttgc

SEQ ID NO: 6018 - DNA, 1182 bp, Homo sapiens
ggccggcccactgggttgtgctttctgccgtacgtcccttcccatgaggatgagatgacccatctgttgcatcccggctgctgataaaacaagaccctcggagccaagaaacaacactgagttccagatttcggaaggttcacgagtgttgccgacacgccctcccaactgcagacatcctccctggaggacctgctgtgctcacatgcccccctgtccagcgaggacgacacctccccgggctgtgcagccccctcccaggcacccttcaaggccttcctcagtcccccagagccacatagccaccgaggcaccgacaggaagctgtccccgctcctgagccccttgcaagactcactggtggacaagaccctgctggagcccagggagatggtccggcctaagaaggtgtgtttctcggagagcagcctgcccaccggggacaggaccaggaggagctactacctcaatgagatccagagcttcgcgggcgccgagaaggacgcgcgcgtggtgggcgagatcgccttccagctggaccgccgcatcctggcctacgtgttcccgggcgtgacgcggctctacggcttcacggtggccaacatccccgagaagatcgagcagacctccaccaagtctctggacggctccgtggacgagaggaagctgcgcgagctgacgcagcgctacctggccctgagcgcgcgcctggagaagctgggctacagccgcgacgtgcacccggcgttcagcgagttcctcatcaacacctacggaatcctgaagcagcggcccgacctgcgcgccaaccccctgcacagcagcccggccgcgctgcgcaagctggtcatcgacgtggtgccccccaagttcctgggcgactcgctgctgctgctcaactgcctgtgcgagctctccaaggaggacggcaagcccctcttcgcctggtgagccgccccgcgcccgccgccttgcctgcagtaaacgcgtttgttccaacccggggccgcggtgcctcctgcgcgtccccccggaggggaaagggccgcgtcccccgcgcgcgaggccagagaaggccccgctcccaccggtgctgggccccgaccgcagcccgccgctgcccgcacctgcggagtgcttctcacccctcattaaaatcatccgtttgcatgtctgccttta

SEQ ID NO: 6019 - DNA, 1962 bp, Homo sapiens
ccgagagcgagggagggctgtgaggactgccagcacgctgtcacctctcaatagcagcccaaacagattaagacatgggaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctggctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactga

SEQ ID NO: 6020 - DNA, 2066 bp, Homo sapiens
gtccaagcccagtgctctttcccctgatgagaaacctttccagatttaaaccattaacaaccctctctaaagaggaggcaagaggtttcaatttcttctcagggaaaaaaagaactgacatcaaaaggtctgtgcggggtcatttgtctcatcatgactttgatttggccttgatctttatttagtatttcagttttatgctctgcaacaagtttggccatgttggaggacaatccaaaggtcagcaagttggctactggcgattggatgctcactctgaagccaaagtctattactgtgcccgtggaaatccccagctcccctctgggttgacattcgtaaccttcctggatcctatcagagaaaccttgttcatcatttcatttccaaattatgaagaccacctgggcctgactgaagatgcttgtttcttcctcttccctaacgccctttccaccagtgcggactgcagattgtcagtggctgctatgcagcaggtgcagcctggtctctcactgagtctctactccacaaaggcaacgactggccaaggcagtggctggctctgggttacacaagtgcagacactcaactaagtgagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 6021 - DNA, 1855 bp, Homo sapiens
ccgagagcgagggagggctgtgaggactgccagcacgctgtcacctctcaatagcagcccaaacagattaagacatgggaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctggatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 6022 - DNA, 692 bp, Homo sapiens
gatcagcagcaacttaaccaaagctctgttacagcctgtagccaagagaaggaacctgtggttcgtttccccagacggtgtgatgaaaagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgag

SEQ ID NO: 6023 - DNA, 749 bp, Homo sapiens
aaagatgacaacatcctggctgttagagagattgtcagtggctgctatgcagcaggtgcagcctggtctctcactgagtctctactccacaaaggcaacgactggccaaggcagtggctggctctgggttacacaagtgcagacactcaactaagtgagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaact

SEQ ID NO: 6024 - DNA, 1904 bp, Homo sapiens
cacgctgaagacattcctgtcttgtgaagcaagtctgtttgtattttaagtttgccaggactaatgaattaaaacatttggactccccacaacttgctgtttatcaatgcctctgacaggaggagggttttcttttgctcttgctttttctagaaagatgacaacatcctggctgttagagaggcaaggaaaggagagaggggttgtgaagggaagcggaagggaagggaagggaggtcccgtgggacgctggggtctggggcagagcaggtagcagcgtgctgccctgacagctgtctccgctcctcagattgtcagtggctgctatgcagcaggtgcagcctggtctctcactgagtctctactccacaaaggcaacgactggccaaggcagtggctggctctgggttacacaagtgcagacactcaactaagtgagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 6025 - DNA, 1964 bp, Homo sapiens
ccgagagcgagggagggctgtgaggactgccagcacgctgtcacctctcaatagcagcccaaacagattaagacatgggaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctggctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 6026 - DNA, 2093 bp, Homo sapiens
ccgagagcgagggagggctgtgaggactgccagcacgctgtcacctctcaatagcagcccaaacagattaagacatgggaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctggattgtcagtggctgctatgcagcaggtgcagcctggtctctcactgagtctctactccacaaaggcaacgactggccaaggcagtggctggctctgggttacacaagtgcagacactcaactaagtgagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 6027 - DNA, 2003 bp, Homo sapiens
atgtacaagggcagccgtggggctggcaacagcttcgtaatcctggcttcctgctttctgggtcaaagccctggtggtgtgttcttgatatcggtccatctagtggcgttgtttgattcctcccaccttgctgatcattcgtagtgtagcccccaaggtgtggaataacccttaagcccttaccggggtccttctggactgagaattgttgtaaagtaatactgctcaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctggatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgattatactaagaataaatggtcacatatcctaaaagcttcttcatgaaattattagcagaaaccatgtttgtaaccaaagcacatttgccaatgctaactggctgttgtaataataaacagataaggctgcatttgcttcatgccatgtgacctcacagtaaacatctctgcctttgcctgtgtgtgttctgggggaggggggacatggaaaaatattgtttggacattacttgggtgagtgcccatgaaaacatcagtgaacttgtaactattgttttgttttggatttaaggagatgttttagatcagtaacagctaataggaatatgcgagtaaattcagaattgaaacaatttctccttgttctacctatcaccacattttctcaaattgaactctttgttatatgtccatttctattcatgtaacttctttttcattaaacatggatcaaaactgaca

SEQ ID NO: 6028 - DNA, 577 bp, Homo sapiens
gccccggttcctgcccgcacctctccctccacacctccccgcaagctgagggagccggctccggcctcggccagcccaggaaggcgctcccacagcgcagtggtgggctgaagggctcctcaagtgccgccaaagtgggagcccaggcagaggaggcgccgagagcgagggagggctgtgaggactgccagcacgctgtcacctctcaatagcagcccaaacagattaagacatgggagatgtacaagggcagccgtggggctggcaacagcttcgtaatcctggcttcctgctttctgggtcaaagccctggtggtgtgttcttgatatcggtccatctagtggcgttgtttgattcctcccaccttgctgatcattcgtagtgtagcccccaaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccag

SEQ ID NO: 6029 - DNA, 556 bp, Homo sapiens
ctcttgtacttgatttcttggtgcgggaaagtgttgggggatttagccaaaagaggagtgcaactttccatccttagatgttatgctaaagtgattcggtgattgtacaatgcataacagtaaaacttttctttttagctaaaatgttaagggaattttaatggtttcttctgttgaatttgagacaatccatgccattccctaggtggctaacaaaatgcttgattctgagcagctggaagacccaggagaaggcggaggctcaggtgcccacatgatcagcacagccagggtacctgctgacaagcctgtacgcatcgcctttagcctcaatgacgcctcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaa

SEQ ID NO: 6030 - DNA, 1682 bp, Homo sapiens
gcacctctccctccacacctccccgcaagctgagggagccggctccggcctcggccagcccaggaaggcgctcccacagcgcagtggtgggctgaagggctcctcaagtgccgccaaagtgggagcccaggcagaggaggcgccgagagcgagggagggctgtgaggactgccagcacgctgtcacctctcaatagcagcccaaacagattaagacatgggaggtgaaagacaacttgagtggttaaattactgtcatgcaaagcgactagatggttcagctgattgcacctttagaagttatgtggaacgaggcagcagatcttaagccccttgctctgtcacgcaggctggaatgcagtggtggaatcatggctcactacagccctgacctcctgggcccagagatggagtctcgctattttgcccaggttggtcttgaacacctggcttcaagcagtcctcctgcttttggcttcttgaagtgcttggattacagtatttcagttttatgctctgcaacaagtttggccatgttggaggacaatccaaaggtcagcaagttggctactggcgattggatgctcactctgaagccaaagtctattactgtgcccgtggaaatccccagctcccctctgggttgacattcgtaaccttcctggatcctatcagagaaaccttgttcatcatttcatttccaaattatgaagaccacctgggcctgactgaagatgcttgtttcttcctcttccctaacgccctttccaccagtgcggactgcagatgatacaccccctgaagactccattcctttggtctttccagaattagaccagcagctacagcccctgccgccttgtcatgactccgaggaatccatggaggtgttcaaacagcactgccaaatagcagaagaataccatgaggtcaaaaaggaaatcaccctgcttgagcaaaggaagaaggagctcattgccaagttagatcaggcagaaaaggagaaggtggatgctgctgagctggttcgggaattcgaggctctgacggaggagaatcggacgttgaggttggcccagtctcaatgtgtggaacaactggagaaacttcgaatacagtatcagaagaggcagggctcgtcctaactttaaatttttcagtgtgagcatacgaggctgatgactgccctgtgctggccaaaagatttttattttaaatgaatagtgagtcagatctattgcttctctgtattacccacatgacaactgtctataatgagtttactgcttgccagcttctagcttgagagaagggatattttaaatgagatcattaacgtgaaactattactagtatatgtttttggagatcagaattcttttccaaagatatatgtttttttcttttttaggaagatatgatcatgctgtacaacagggtagaaaatgataaaaatagactattgactgacccagctaagaatcgtgggctgagcagagttaaaccatgggacaaacccataacatgttcaccatagtttcacgtatgtgtatttttaaatttcatgcctttaatatttcaaatatgctcaaatttaaactgtcagaaacttctgtgcatgtatttatatttgccagagtataaacttttatactctgatttttatccttcaatgattgatta

SEQ ID NO: 6031 - DNA, 2027 bp, Homo sapiens
gcgctttggttcttggaaggcggtgctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttgacatcaactgtggtgtccgcttgctaagaaccaatttagatgaaagtgatgtccagcctgtgaaggagcaacttgcccaagctatgtttgaccacattcctgttggggtggggtcaaaaggtgtcatcccaatgaatgccaaagacttggaggaggccttggagatgggggtggactggtccttaagagaagggtatgcctgggctgaagacaaggagcactgcgaggagtacggaaggatgctgcaggctgaccccaataaagtttctgcaagggcgaagaaaagaggccttcctcagttggggaccctgggagcaggcaaccattatgcagaaatccaggttgtggatgagattttcaatgagtatgctgctaaaaaaatgggcatcgaccataagggacaggtgtgtgtgatgatccacagtggaagcagaggcttgggccaccaagtagccacagatgcgctggtagctatggagaaggccatgaagagagacaagattatagtcaatgatcggcagttggcttgtgctcgaatcgcttccccagagggtcaagactatctgaagggaatggcagctgctgggaactatgcctgggtcaaccgctcttccatgaccttcttaacccgtcaggctttcgccaaggtcttcaacacaacccctgatgacttggacctacatgtgatctatgatgtttctcacaacattgccaaagtggagcagcatgtggtggacggaaaggaacggacactgttagtacacaggaagggatccacccgcgctttccctcctcaccatcccctcattgctgttgattaccaactcactggacagccagtgctcattggtggcaccatgggaacctgtagttatgttcttactggcactgaacagggcatgactgagacctttggaacaacctgtcatggagcgggccgtgcattgtcccgagcaaaatctcgacgtaatttagatttccaggatgtcttagacaaattggcagatatgggaattgcgatccgtgttgcctcacccaaactggttatggaagaggctcctgagtcctataagaatgtgacagatgtggtaaatacctgccatgatgctggaatcagcaagaaagccattaaactgagaccaattgctgtgatcaaaggatagaaccttggacagcagggctgcctgacaccaccaaccctctctgaagtggaagtggactgacatgctcttctgacatcagactcaaggcgggacaagttgcaaagtgtgcagctgtaactgctcacgccaaaatggctgatggggaggctgctgctttcaggggcccgtgcttgtaaaataaccttccaggaagaggcacattgcccacctttggaaagggaggaatatgccttctccttggttgttccacagagttttaggaaaatctgttagggatgggtagatgtcaaactgccttacgcagtcatactgatctttagccatcagattgatcttcttcacaccaagctctgtttacattccgagaggtgtcatgaagaaagttctgttcaataaggttttggaatgtt

SEQ ID NO: 6032 - DNA, 1188 bp, Homo sapiens
ggcggtgctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttgacatcaactgtggtgtccgcttgctaagaaccaatttagatgaaagtgatgtccagcctgtgaaggagcaacttgcccaagctatgtttgaccacattcctgttggggtggggtcaaaaggtgatatgatgagggccgtgcattgtcccgagcaaaatctcgacgtaatttagatttccaggatgtcttagacaaattggcagatatgggaattgcgatccgtgttgcctcacccaaactggttatggaagaggctcctgagtcctataagaatgtgacagatgtggtaaatacctgccatgatgctggaatcagcaagaaagccattaaactgagaccaattgctgtgatcaaaggatagaaccttggacagcagggctgcctgacaccaccaaccctctctgaagtggaagtggactgacatgctcttctgacatcagactcaaggcgggacaagttgcaaagtgtgcagctgtaactgctcacgccaaaatggctgatggggaggctgctgctttcaggggcccgtgcttgtaaaataaccttccaggaagaggcacattgcccacctttggaaagggaggaatatgccttctccttggttgttccacagagttttaggaaaatctgttagggatgggtagatgtcaaactgccttacgcagtcatactgatctttagccatcagattgatcttcttcacaccaagctctgtttacattccgagaggtgtcatgaagaaagttctgttc

SEQ ID NO: 6033 - DNA, 4433 bp, Homo sapiens
gttaccatagcgacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgatccattgtttattgtgtcaagtgagaaagaccatacacaggcaaatatccaagctaccctgattcgcagcagactgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggttaaagttcaccatagtactataagctcctacctagaagacataatactgaataccgaagcgaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaactggaaacccaagtgtccatctccatcggaacagaaaactatactttggtctgcttctacagtggcacatcaacccacctttgagctttagatctaagaagtgtgttcatgcaacagccatagagatggtgctattgaaaggcaatctgcccatcctgtgtattgacaagcatcaggattccaggaggattcttcctgattcaaagactgtcaaataggaaaaaagaaaacagtaaatgaacaaaaacatcaacatggagtccaagtaatgaatttatagaggaaaatgtatgctactctgaaaacaaagcttatgttagagaatatcttactgtaagaaacaaggaaaattgcagaaacatttgctgagtgtttttaataggagtcaaaaagaaagggtcttttcagaaactgaagtaggaaataataacagacaaggtcaaaaaatagatgcaggctgaaaagaaaaggaagtgggctaagatgggaaaaatataaaaagatttaaaatccagcaacaaaatttacacattcatttggatgcagtgaaaagggcagaaataccacagcagagaataaaattgataatgttggcaacacatttattaagtgatccaacatgggatgggaaggaatgggcaaagagattaaaatgacagaagttagctgtagatgacctatcccacagcaatcggagttcttgaagaagaaaccagaacaaataaaatagaaacaataatcagagtttaataattaattttctgagtttttttttaaaaaaactaattatacaaacttgaaagggttcaccttgccctagcaaaactaggattgggacacctttttttccccctgaggatcactgacaaaaaacactgcaccagtaaggaagcaactaaattttgttttgttctttgaaaaaggctaacctgagctaggtaaaggttatatcattcacttttgaaataaaccatcgagaacacaaaatgacaagtgagttaggttgggctgatgggatagaaggtgggaggggaatgctatacagctgggaacagcagactttctctgaagggccagatggtaactacattagggtttgcgggtctgatggtcgccatcataactgcatactcaactctgccgttgtagggtaagagcagcactcgatgacacagaaatgaatgcacatgactgtgttccagtaaaattttattttaattaaaatcaattcatgtttgaaaaaggatttaaagtagcttctaataaaggacatgtgtaatgaaacttaaaatatgatattttctttaaaaatctttatccttatgtagacttctaaaactatgttttgcatttagacagtcaaggaaaatacaagttgttatacaattctcattgactaattgaagtttactaggagaggaaaactttttcttgataccggcaatcttttacttataatggcttgagttaaaatgctccaacttttctaatttttgcttttgaaaataaaacacctatagtgacaataaaaacacacatttaaagccaa

SEQ ID NO: 6034 - DNA, 4364 bp, Homo sapiens
gttaccatagcgacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgatccattgtttattgtgtcaagtgagaaagaccatacacaggcaaatatccaagctaccctgattcgcagcagactgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaagggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtcggggtctcccagcaggacaagctgaggtggagatgatagaaagagcccgcgagaagcgtgcttgggaagcctctctccccgctctgagtgacacctcccagtttgagaagaggaggaaaatgatgaatgaaatggagaggaaggagtgggccttcagagagcaggagattgaaaaactgcaggagattcgcctggaagttctaaaagagctgttgaggaagcgtgaagagaatcagaatgaagtgaatatgaagcacttgaatgcccggtggtctaaactgcaggagggaaaagaggcaaaaatggcaaaaattcagcgcacgcatgtatcaacaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccccctcgcttccttcaaagaaacccaatacctcaacctcggcttccaactccaaccttggaaatgacgtccaatgaagaagaagaaatggaaatggctgtgatctaccttcaaaagttactccggggcagagtcgttcagaacatgatgtttgaagggaaagaaaagcgactggagttgatccaggagttgcgcacctgccacgcactacaagaagatgaaaagctggtgaaaaaagccgagaagcaagtgaccctggccttacagcggcagaggaacttgcatgagcacaaggtgtcactggttgaaaaccatttggccggactggaaggaagggcactagcagacatgtttgacttcctgtccaaagagctggtgagactgcaggaggagaggaggatccatgcctttgtcatgctggctgagcgccagcggcgggtacgagaggctgaagagagtggtcggcgccaggtggaaaaacagcgcctgcgggaggaggacgagatatttaaggaggtggttaaagttcaccatagtactataagctcctacctagaagacataatactgaataccgaagcgaatactgcagaagaacaagccagggcagaaatagagaagatggctgagaaaatcaatgacattgcttatgaaatggaaagccgccgaacctatcttcagtcagaggagattgttgctgagttggtttatagttttctgatcccagaggtgcaaaaatactttgtcaaagaaaaagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaagattgtgatttttttgtaaaagaagctgtacgaatcatcataaataattccaatagtctgcacttctcccaaggtgtgcactgctcataaacttgccagtgtgtgattcatgagaaaggagatttattttccttaaacatccaataatttaaaatgattttcaataataataatcaaatgaaaaagcttcattctcttcagtgtcttctagatgccctacttaaagagaacattttcttatgtctcatttcaatattttgttaactatgaggatgtgctggtttgttgaatcaaacaaaaggaaatgttgtggaatatttttccaagtagttttggttcactattcacaggacattggcattatctactaaggctgaaaatgtgcatattccatgactcaggattttatctcctagatatatattcaacagaaatgcatgagtatgtgcaccaacaggcatgacaaaaatatttatagtagtggtgttcacaatagtcccaaactggaaacccaagtgtccatctccatcggaacagaaaactatactttggtctgcttctacagtggcacatcaacccacctttgagctttagatctaagaagtgtgttcatgcaacagccatagagatggtgctattgaaaggcaatctgcccatcctgtgtattgacaagcatcaggattccaggaggattcttcctgattcaaagactgtcaaataggaaaaaagaaaacagtaaatgaacaaaaacatcaacatggagtccaagtaatgaatttatagaggaaaatgtatgctactctgaaaacaaagcttatgttagagaatatcttactgtaagaaacaaggaaaattgcagaaacatttgctgagtgtttttaataggagtcaaaaagaaagggtcttttcagaaactgaagtaggaaataataacagacaaggtcaaaaaatagatgcaggctgaaaagaaaaggaagtgggctaagatgggaaaaatataaaaagatttaaaatccagcaacaaaatttacacattcatttggatgcagtgaaaagggcagaaataccacagcagagaataaaattgataatgttggcaacacatttattaagtgatccaacatgggatgggaaggaatgggcaaagagattaaaatgacagaagttagctgtagatgacctatcccacagcaatcggagttcttgaagaagaaaccagaacaaataaaatagaaacaataatcagagtttaataattaattttctgagtttttttttaaaaaaactaattatacaaacttgaaagggttcaccttgccctagcaaaactaggattgggacacctttttttccccctgaggatcactgacaaaaaacactgcaccagtaaggaagcaactaaattttgttttgttctttgaaaaaggctaacctgagctaggtaaaggttatatcattcacttttgaaataaaccatcgagaacacaaaatgacaagtgagttaggttgggctgatgggatagaaggtgggaggggaatgctatacagctgggaacagcagactttctctgaagggccagatggtaactacattagggtttgcgggtctgatggtcgccatcataactgcatactcaactctgccgttgtagggtaagagcagcactcgatgacacagaaatgaatgcacatgactgtgttccagtaaaattttattttaattaaaatcaattcatgtttgaaaaaggatttaaagtagcttctaataaaggacatgtgtaatgaaacttaaaatatgatattttctttaaaaatctttatccttatgtagacttctaaaactatgttttgcatttagacagtcaaggaaaatacaagttgttatacaattctcattgactaattgaagtttactaggagaggaaaactttttcttgataccggcaatcttttacttataatggcttgagttaaaatgctccaacttttctaatttttgcttttgaaaataaaacacctatagtgacaataaaaacacacatttaaagcc

SEQ ID NO: 6035 - DNA, 939 bp, Homo sapiens
gacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacgatccattgtttattgtgtcaagtgagaaagaccatacacaggcaaatatccaagctaccctgattcgcagcagactgagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacaactgacgcttcttttcagatgcctaaagaagtttatgaagatcctgaagttactggaaagaatcgctataaatactttgaaaggccttttctcccattttttcagcagatgccattcaatgttgtttatgccgtatccaaggcagaaccatacacttttcctcctacttctactaagcacctatccatcccttcaaagtctactgtgggcactcagactgattatcgggatgctgacgttcaaacagatccatactctgcagaatatgtagtatgtcaggactcaatccctgagctcttgaccctggctacgcttacttggggtgagttggtaaatctcctgactattggcagatgacgatgctgataaccacgcatgctgttcaaatggcccatgtacaggcaattgtggtttacagtgttgctatataaagtgtcttagtacagcaacttcatagactcataatttttctgatacttctggtcaaataaagatactatctttttattgtga

SEQ ID NO: 6036 - DNA, 2277 bp, Homo sapiens
gctcgactcgccggcgctgtggcctcccgcggagccgctcagactttccctgccggcacatggacctggcccaaccctcacagccagtagacgagctggagctctcggtgctcgagcggcagccagaagagaacacgcctctcaatggtgccgacaaggtcttcccttctttggacgaggaggtccccccggccgaggctaacaaggaaagcccctggagctcctgtaataagaatgtggttggaagatgcaaactgtggatgatcatcacctccattttcctaggtgtcattacagtgatcatcataggcttatgtcttgctgcagtaacttatgttgatgaagatgaaaatgaaatacttgaattatcatcaaacaaaacattcttcatcatgctgaagattccagaggagtgtgttgctgaagaggaattgcctcacctgctcaccgaaaggctcacagatgtgtacagtacatcgccctctctgggtcgttattttacttcagttgaaatagtggacttcagtggtgaaaatgccacagtaacgtatgacctgcaatttggggttccatcagatgatgaaaattttatgaagtatatgatgagtgaggagttggtgctgggcattttgctacaggatttccgtgatcagaatatacctggttgtgagagtctggggcttgatccaacatccctcttgctctatgaatgaagtgatggaggctggtctctgtctgaaagcagtgctctaccaagtcctggagatgaagggaattcactctgttttgcagaaaagattctgtggattaatacagaagcaccagcaacaccagaggggtggagactcctttctctcccgattctacagtctggctctaagcccagtaaaacagctcccgagcactgcttcagctgggtccagtcttgacaaaggcaggaagccagctagggtgggggcgatagggtcagcgggtatgtcccactgttggaggtcactggtattctgtttgtttttgttttgtttcgttttgttttttgagacagggtctcgttctgtcgcttagctggagtgcggtggcgtgatcatggcactgctattcttgaagcactccacccacctgggctactttttctttagtgcagaggtgcactgtcttcttttaggtgggatcgcgtaagcatgagctggtagagcacggagaggcaggcagccaggttacgaagactaagccaattattcactgaagtcatcctcctcccccccaccattcgatttgatctacctctaagccaggctgtgaagaaaaggaaggcactttagaagacctcagcagtgtggttctgtgtctacttccatgacctgtacctgagtatcttagccagccagccttaggaacaccaccaaggttactttgaaatctatgtatatagctagttacagacgggagctatgtgtttcttcattattttgcagctcctcgttgttcctgtgattcctgaacacctttttggaaatatgggtctctgtgagttttgagcacactactatcactttggatagtcactccatttatatttttataaacttccattagagaatcattaaggctgtttaatatctgctctggatattacgcattggctttttgttgcctagtgctacaaaccttcctgtgggactcagtgtcttcaggcaatgattgtgtatcctgttacagatggttgtgatacaagaagaaccactcttctttgaaaataaactcttggaagcttttgccagctatttggggggtaggaggaatattagcaactgtattggttgtctacagatacagaattgcctgttgtgagggaactgattgttttgttgggaaaagaaatttaccaggagaaagagttttgtgctgtattgtgagagatctcgcctctcagttaaatgagccctgggttaaagtcagtgtgaagggcagctgtgtgcgggcacgagccagagtgtctgcctcagactagatttgacttgagttctttatgacccaggactctggataatgtgaatttgctttcctatttaactagaagatacatgtactatagatcattgtctcattttagtgattgttccttaaactagtgaaactagtggatttctcttcttcctctttattttctgcatgttaaatgtgaaccttagtgtatttgtattttgtagaaaataatgaaaaattttaatggagaatgatttaaaaacatttacaatacattatttttgcatctgt

SEQ ID NO: 6037 - DNA, 517 bp, Homo sapiens
gaggcggggaggtcgctcgactcgccggcgctgtggcctcccgcggagccgctcagactttccctgccggcacatggacctggcccaaccctcacagccagtagacgagctggagctctcggtgctcgagcggcagccagaagagaacacgcctctcaatggtgccgacaaggtcttcccttctttggacgaggaggtccccccggccgaggctaacaaggaaagcccctggagctcctgtaataagaatgtggttggaagatgcaaactgtggatgatcatcacctccattttcctaggtgtcattacagtgatcatcataggcttatgtcttgctgcagtaacttatgttgatgaagatgaaaatgaaatacttgaattatcatcaaacaaaacattcttcatcatgctgaagattccagaggagtgtgttgctgaagaggaattgcctcacctgctcaccgaaagggaagtaggactgaagccgaatcctgaagcactggtgggatttgaataa

SEQ ID NO: 6038 - DNA, 2054 bp, Homo sapiens
gaggcggggaggtcgctcgactcgccggcgctgtggcctcccgcggagccgctcagactttccctgccggcacatggacctggcccaaccctcacagccagtagacgagctggagctctcggtgctcgagcggcagccagaagagaacacgcctctcaatggtgccgacaaggtcttcccttctttggacgaggaggtccccccggccgaggctaacaaggaaagcccctggagctcctgtaataagaatgtggttggaagatgcaaactgtggatgatcatcacctccattttcctaggtgtcattacagtgatcatcataggcttatgtcttgctgcagtaacttatgttgatgaagatgaaaatgaaatacttgaattatcatcaaacaaaacattcttcatcatgctgaagattccagaggagtgtgttgctgaagaggaattgcctcacctgctcaccgaaaggaatgaagtgatggaggctggtctctgtctgaaagcagtgctctaccaagtcctggagatgaagggaattcactctgttttgcagaaaagattctgtggattaatacagaagcaccagcaacaccagaggggtggagactcctttctctcccgattctacagtctggctctaagcccagtaaaacagctcccgagcactgcttcagctgggtccagtcttgacaaaggcaggaagccagctagggtgggggcgatagggtcagcgggtatgtcccactgttggaggtcactggtattctgtttgtttttgttttgtttcgttttgttttttgagacagggtctcgttctgtcgcttagctggagtgcggtggcgtgatcatggcactgctattcttgaagcactccacccacctgggctactttttctttagtgcagaggtgcactgtcttcttttaggtgggatcgcgtaagcatgagctggtagagcacggagaggcaggcagccaggttacgaagactaagccaattattcactgaagtcatcctcctcccccccaccattcgatttgatctacctctaagccaggctgtgaagaaaaggaaggcactttagaagacctcagcagtgtggttctgtgtctacttccatgacctgtacctgagtatcttagccagccagccttaggaacaccaccaaggttactttgaaatctatgtatatagctagttacagacgggagctatgtgtttcttcattattttgcagctcctcgttgttcctgtgattcctgaacacctttttggaaatatgggtctctgtgagttttgagcacactactatcactttggatagtcactccatttatatttttataaacttccattagagaatcattaaggctgtttaatatctgctctggatattacgcattggctttttgttgcctagtgctacaaaccttcctgtgggactcagtgtcttcaggcaatgattgtgtatcctgttacagatggttgtgatacaagaagaaccactcttctttgaaaataaactcttggaagcttttgccagctatttggggggtaggaggaatattagcaactgtattggttgtctacagatacagaattgcctgttgtgagggaactgattgttttgttgggaaaagaaatttaccaggagaaagagttttgtgctgtattgtgagagatctcgcctctcagttaaatgagccctgggttaaagtcagtgtgaagggcagctgtgtgcgggcacgagccagagtgtctgcctcagactagatttgacttgagttctttatgacccaggactctggataatgtgaatttgctttcctatttaactagaagatacatgtactatagatcattgtctcattttagtgattgttccttaaactagtgaaactagtggatttctcttcttcctctttattttctgcatgttaaatgtgaaccttagtgtatttgtattttgtagaaaataatgaaaaattttaatggagaatgatttaaaaacatttacaatacattatttttgcatctgtgttgttgcattcccat

SEQ ID NO: 6039 - DNA, 4346 bp, Homo sapiens
cttggtctcaggagagccagcgcgcacaagcaagggtgtgcggctctgagacgtgcgttgctgcttgtgggtgtgagacatcctagctcctcttccccttccgtgagtccctcctttcctcgcagaccccacttgtcgtggctggctgccgccgcagctcttgtgcgaagccagcagtgcgcgtgcgcgcgggcacgggcgcgcgaccgtcgggtccccgcgctccctccccctcccgctcctctataacttggctggcgtggaggaggcgccgccggagtcggagggcggggagctaggaggagggagctcgagagttgtggagactagtgactgggagaagtcgcagcccgctcaggcccgcgccttcccgctccccgtcttcctctctcacacacctactccgccctccgccccagcccgcgcgctagctccttctctcgcccggggttcctgccggtagctctccgggtcttggcgcggcgggggcgccccgggggtgccctcgccctcccgttgcgggcgggcgggcggtatgtggcgcctggtgcccccgaagctgggccgcctgtcccgctcgctgaagctggcggcgctgggcagcctgttggtgctgatggtgctgcactcgccgtcgctgctcgcctcttggcagcgcaacgaactgaccgaccggcgcttcctgcagctcaataagtgcccggcgtgcttcggcacgagctggtgccgccgcttcctcaacgggcaggtggtattcgaggcgtggggccgcttgcgcctgctggacttcctcaacgtgaagaacgtgtacttcgcgcagtacggcgagccccgcgagggcggccgccgccgagtggtgctcaagcgcctcggctcgcagcgcgagctggcgcagctcgaccagagcatctgcaagcgggccaccggccggccccgctgcgacctgctgcaggccatgccccggaccgagttcgcgcgcctcaacggcgacgtgcgtctgctcacgcccgaggcggtggagggctggtcggacctggtgcactgcccctcgcagcgccttctcgaccgcctggtgcgccgctacgcggagaccaaggactcgggcagcttcctgcttcgcaacctcaaggactcggagcgcatgcagctgctgctgaccctggccttcaaccccgagccgctggtgctacagagttttccgtctgatgaaggttggccatttgcaaagtatcttggagcttgtggaagaatggtggctgtaaattatgttggagaagaactgtggagttactttaatgcgccatgggaaaaacgagttgacctcgcttggcaattaatggaaatagcagaacagcttacaaacaatgactttgaatttgcactctacctcctggacgtcagctttgacaattttgcagttggtcctagagatgggaaggtaatcattgtggatgctgaaaatgttttggttgctgacaaaagattaattagacaaaataaacctgaaaattgggatgtatggtatgaaagcaagtttgatgactgtgataaggaggcttgcttatcattttcaaaagaaattctttgtgctcgtgccactgtggaccacaattactatgctgtttgtcagaacctcttatccagacatgccacctggcgtggcacttctggaggactccttcatgatccaccaagtgaaattgccaaagatggccggctcgaggccttgctggatgagtgtgccaacccaaagaagcgctatggcagattccaggctgcaaaagaactgcgtgaatacctagcacaattaagtaacaacgtgaggtagtctatggtgaacttttctttttttctccatttaaacagcactggctaaaactaaaccaccaaaaaacgatctgaaaaaatgaaatttggaagtgttacattcagaggatgataaacttgcactgatagatcttaatgttaacatccatcaaaataagacattacttcaaaaatcacatgatgcttctgcaaataagtatgttcttatactttggaggcttgagctgtcatcagctgctccccactaccccggaatgcttgagtggattaatgaatattgttaagctattggaaatgagtctgatagtacattggcttgtgtatcaaagggtacttggtacttagtttgcatttactatcatgattttgtgaatctcttgcatttactttgaatgtcaagtcagattggtctgttttataggccgctttttccttctgatgtgtagggttttttccccctttttttttttaattaaattttgaaaattcaggttactgtaggtgttcatttaaatttttaatagttgtcattcagtgctatttggtacatatttactgttagggcaggattcccaggtttactgtgttttttttttttttttttaaagaaagctaaatattacattatgtaaatacttcttttcaccaacttctgtagtttcaccattgcatggtgtcatttcaggttatttaacagttatatccctctatgccaataattagaagtgtacactaaacatgaagtttggcatatgttgcaaaatgtcattttatcttttctaaaggctttaagaagaatatactagaatctatatattgatgttaattttgattcagaaaaaaaatacaacccagtatctaaaaagtgttaactagtccaagatagtaatgcatatgccaaagaaatattacacctaatctcatgtttagaatttaaaatagaattggtcagctacttattcttaccaccctacttccagtattttagctctgtcattattaaattcagatcttcctgattattttttctgttgaaagttaaactactgctttcaagtaatttaaagttatcctaccttttattcatgggtagttttgcaaaattaacatggtagccattgtttgaatttaatcgggcatcataacttttcatttattgaggaactaatcattattactataaagcatacaaattagccagtcagcacactttggtcttctttacctaagggttaaacatcagaacatcaaatttaattatttgcatagaaatgtgtgggctctttatataagttgactatcactaacaggtaatatttttctgtttgaagttgttacttttgtttacagcaaagtttgatgtagtgtgcagtagtgagctctagactgatctttttctaaatcagaaagtgattaaagtatgcacaaccaaaggcaggtttttctttttcatttattcagcaactatttattaagcatcaactctgtgccaggcacgttactagctgctacatactgtctgaacatgacatacggttaagtaactttacaattattatcaaatacttcaatgtagatatttcttaagttgaaatagcattaactaggataatgctttcatgttattttattgtcttgtgatagaaattcaacttgtaccatctaaaactaggttgctataaaaataggaggatgaagtcaataaagtttatgccagtttaaaaactggaaggaaaaggtaagagctctccattataaaatagttgcattcggttaatttttacacattagtgcattgcgtatatcaactggccctcaatgaagcatttaagtgcttggaattttactaaactgacttttttgcaactttgggagatttttgaggggagtgttgaaaattgccaaacactcacctcttactcaaaacttcaaataaaatacacattttcaagagggagcaccttttatatttgataagttttcattataaaccttataataccagtcacaaagaggttgtctgtctatggtttagcaaacatttgcttttctttttggaagtgtgattgcaattgcagaacagaaagtgagaaaacactgccagcggtgattgctacttgaggtagttttttacaactaccatttcccctccatgaaattatgtgaaatttattttatctttgggaaaagttgagaagatagtaaaagaattaggaatttaaaattacagggaaaaatatgtaagtgaaaagcaataaatattttgttcactttgctatcaagatgttcactatcagatatttattatatggcagcaatttatatttttaatcattgcccattaatagacgcagtaaaatatttttgaatcagacatttggggtttgtatgtgcattaaaattgtcttttgtactgtaagttactgttaatttgaatattttattgaactgtctccctgtgcctttataatataaagttgtttctacaacttttaatgatcttaataaagaatacttta

SEQ ID NO: 6040 - DNA, 1876 bp, Homo sapiens
agttcggactcggccgggctgggccaggctgcaggcgtgggaaggggcgtctccgggggagccccggggctgtgcagggaggccgagggcgaccccgctgatggagagtctgctcttgttacctagattcgggcgcatttcggatttgactgtggatctttcaacgccagagggagtgcgtctcttaacactccccaaaatgtctctactgcgagtttccttccgctctctaccctgcctttctgcttttatctgccggggcttgcaggtccgcggcgcagactgttcacgagcccttggacctttcctagttcttctgaagtgttctacaccgcgttcgctcttccttttctggcgctggtggctggcctaacttcggtctcagagtctttgttttcgctcatttacctggcagtcatttggacacctaattcgaggacaagttggggaggatgaagtcggagaacgggacagtggtcgggagttttccgtctgatgaaggttggccatttgcaaagtatcttggagcttgtggaagaatggtggctgtaaattatgttggagaagaactgtggagttactttaatgcgccatgggaaaaacgagttgacctcgcttggcaattaatggaaatagcagaacagcttacaaacaatgactttgaatttgcactctacctcctggacgtcagctttgacaattttgcagttggtcctagagatgggaaggtaatcattgtggatgctgaaaatgttttggttgctgacaaaagattaattagacaaaataaacctgaaaattgggatgtatggtatgaaagcaagtttgatgactgtgataaggaggcttgcttatcattttcaaaagaaattctttgtgctcgtgccactgtggaccacaattactatgctgtttgtcagaacctcttatccagacatgccacctggcgtggcacttctggaggactccttcatgatccaccaagtgaaattgccaaagatggccggctcgaggccttgctggatgagtgtgccaacccaaagaagcgctatggcagattccaggctgcaaaagaactgcgtgaatacctagcacaattaagtaacaacgtgaggtagtctatggtgaacttttctttttttctccatttaaacagcactggctaaaactaaaccaccaaaaaacgatctgaaaaaatgaaatttggaagtgttacattcagaggatgataaacttgcactgatagatcttaatgttaacatccatcaaaataagacattacttcaaaaatcacatgatgcttctgcaaataagtatgttcttatactttggaggcttgagctgtcatcagctgctccccactaccccggaatgcttgagtggattaatgaatattgttaagctattggaaatgagtctgatagtacattggcttgtgtatcaaagggtacttggtacttagtttgcatttactatcatgattttgtgaatctcttgcatttactttgaatgtcaagtcagattggtctgttttataggccgctttttccttctgatgtgtagggttttttccccctttttttttttaattaaattttgaaaattcaggttactgtaggtgttcatttaaatttttaatagttgtcattcagtgctatttggtacatatttactgttagggcaggattcccaggtttactgtgttttttttttttttttttaaagaaagctaaatattacattatgtaaatacttcttttcaccaacttctgtagtttcaccattgcatggtgtcatttcaggttatttaacagttatatccctctatgccaataattagaagtgtacactaaacatgaagtttggcatatgttgc

SEQ ID NO: 6041 - DNA, 5334 bp, Homo sapiens
acttccgcttacgcgccccacttccgcttccggccccgggctgtggtgactggcggtgtggggtgggtcagagggcagtaggtacctccaggcgggagcagcgtttgcaccgcggtgggttcctgcgagctggtgcagaggggccccagcgggccggccccggggcacatgcgacgacctccacccctgggccccacgacggcctcagggcctgaaggcaatgtgcgaaacctgcagaagcggcaggcgccagggccaggcgcggcgggaggctgtggccctgaggccggggggtgccgggaaaataagcaaaagaggagaatggtggcccgggccacccctgggagaggcgaggtggaaagtgataagtcggttgcagcatcaggggctggaaaggccgcaaggcgtcaggtggaggggcgcaggggcccggtgagcccgtcagactcgtcagacccgcgaggcctagaagcagcaaaggaggctgaactccccttgcaaacggaaagacacaccaaggaaaaaagaaaagttactgaagcctcaagtgatgatccacagccagggcttgacttggtaagaaaggaatcattaaccagttcggaatctttccaaacagtggaatgcttgcagtctttgggtaaggaaagtataatagaaggtattaaaagaagaattcgaaataaaaaacttaaaagcttagaaaacccacctctcaaaataaccgaaaatgaggctacacaaaatattaaggttgaattccaagatgaactgtacaagaatactccaaaatattcttgtaatatcttgtcacctgaagtagaaaataattccgttttaaaattacgtgattgcaattgtttcccccattccaagggttgtaatgatgaaaacaacctgccatataaacctgatggtggatgtatgcatgtagcagaaaatttctcaaagaaagaaaaccttaggagtcttgcagagaagagtgacacaaatagtattcctcagctcttacaaacagaagaaaatgtaatgggagtaaataagttactaccagaagagagtgatttataccaaagtaaaaccaatggcttgctttcctgccttcaacatgaaaaaaataaatattcaatagaggagagcagtgttgggcgaaaacccaggaaaaggatgaagttgtctgaaaaagcagatgaaacagttactgagatgaacttctctaatgagtataacaagtctgagttgatgttgcaagaaaatcaaatgattgctgatggtaaagaagcagagactaaaagtcctttaaatgttttgagaaaagtaagccataatacagtctctttgatggatcatttattaagtgtcccagaaacagtagaaaaagaaacaagttctgaacatcatgtaaatgctgtgtttcagaaaaccattgaaccacttttgaaagaagaaacagagaatgcttcagagccgttaggttatgaaagcatggcatcgaaagaggattttaaatcgatgaaaagcttcatagggaaatcacctaatgagtaccatattgaaaggagatcttcacgggaagacttaagaagtgcatctgaagaattgaagttaagctgtcagagaacaatacctatgactggtaaaagaacttggccctattattcatgtgctagaatatctgcctggtgttggaaaaaggcttccttgccagaatcaagttactttcttcgtgggtctcaggaaagttgtaggcaagttgatgtccctaaacaccaaacaaaccagacccatttaactgactccaaattattattacaaagttccttaacagaaacaaacactgaatcttcaagtaaagaaaaattagattctaattctaattgtttgtcttcagtttctgcagtagaacctactttaatggttataaaggaacctataatcaaggatgataaaaagataaaatcagaggaactgagcagaagagggtcagaggtaatttctaacactactgaagatactcaattaaccagtgagactcaaagcttaacgggaaataaaaaaaaagctagaggaaatttaacgaaacttaatttgacagcgacttccaaagatggtcaggaagcaaataactctgcaggcaaaactattcatcgaaaagcatgcattgctcaacaaacatttatagttccagacttggttaaaatattgaacacaggacggctgactaattttaaaattcctttacttaagaataaatcagaaaaaagaaaagaagtaaatgccaagtcatcagagagagaagcttacagtcctctagaacttctggacaatttatctggagcagacgtaagacagaacaggagtaaagaaaatgtctccatgatgatgttaggacctcaaactttgagcatacgaaatagtgtaactccagtgcaagctagttctgactcattctacaataagaaatcctatagtatttctccaagctttacaaagcaaggtaacaatagcaaaccatctaatcacgtctctgaaccaggcaatattgtttctaataaagaagttgcttctctcacagttgaaaataatgctttttcttgtgatcctgggtatgtagagaaaagtccttccttctgctgtaatgaacaagaaacattccgaccagtgtccagtgaagttaggggtagaaaaataactaagaatttttcagaggtagggtttccagatattcttaaagcatatgaagatgacgtcctcttaattgatgtaattcaagatgacccagacctctttggagtctccaatgaaggggagctctcatttacttctgaggtcccaaagataagccaggagcccaatgttgctggagagcaccaatcaacagactccaagtacatggaaactccagtaaaaaaagaaccaagtgatgacttaagagaacttcctgtactggactgtggatggataaagccagacatctgtgcttccaactcagcagaaagtgaaataaaacgtgatcccaaagatgtaaacacttccttaggagaagttgctaatgagacctctgaaaatgaaacactgggagacttcagtgaacaaataaaaggttcagacttggatgaaaagcatagatttacagacaaagtgattaccaaagaagaaaaagaaaatatttatgaagtttgcaaaagcaaagattctagaaatgcagactttatggtcggcgaatgtcaatttgcagtaccagtcccgaaacctctgtgtttattagtacctcctttgaatctaagtggtcgtcaagaagacacaatactgaatacctggatgaatgatttcagatttctgggaaaacattctgtcctaaagctgcagaatcctgaaacttgtgaaatattcaagagggaaaaaaatgtgggggtgttccagaagtccctagggttgatgataccctataaatattgcaaatttcattttaatacattacgtggctgtgagcgaccactgtgcaagtttgctcatgtgcctgaacaaggggatgaaaaggtttgcatggatgtgtttaagaaatatataaatatcaatgaactgtgtttgctacagcgtgcagtaaacatatttatggagtactacagaaagtttcccccaggtgtatactttgatttacaagtgctaaatgaccttctaaattctttactcaaacattgtttgttgaaagaagtatttcagatagtgaacctcagcataatggttaaaatgctgccttctctgaaaatattactaaacatatttgagtatgtggcaactatgaaattaaggaatgctgtacctgctttaattgatatcttttgcaagcttgttgaagccgggatggtgcttgacccagagcactttaactatattgttaagcttttataccaagtacaagcttccaaacaagaaataactgcagttctggaaatgaaatcgaggttacagatgagacgatttaaaaagaactggaagtgtgatttagattcagccttgaataaattagagcattgtaaagaaaaaggtgactggaccaaattgggaaaattatacattaacgtaaaaatgggctgtgaaaaatttgcagatttccagacattttgtgcttgcattgctgaaacactcacaaaaaactatgaagatgaaagaccagatattcccttttgtgaatttgctgaaacagttagcaaagatccacaaaacagtaaagtagataaaggtgtactgggaagaattggaatcagtgctatgtacttctatcacaagctgttgcagtggtccaagggaaggaaggtcttagagaaactatatgaattaaaaatacactttacaagtttaaaaggacttatagggcctgagaagttagcatcaagatgtcaaattgtgaatgttgcagcagaaatttttctaaaaagtggaagcctagatggtgccatttgggtaatgagggagtcagagtggataatcaatacgcctctgtggccttgtgatagactggatgtgcttaatcgacataatttactctgtacaattgcacatgaaatcttagccaagagcctttatagacagacatttgaagttttgcagaatctaccaggttttcaaaattcccaagaaactgtggaagtctcacaatatagccttctttttaataagcttctaggttcctgtatagaaagcagtagtcttggtatgtcatcctctgtggcagaattcatgatttcaaagagcatccctattgatttttcctttctcagaagattaattacttctttaggaaggagtcgtttatggctcaaagccagagcccactacaaaagtgctctttccttgggttgctacccaccattggaaggaaatttataccgaaaacttcttctaattccatcttatttatctgagattgaaatgctcttagctattgaaatcttcatggtatctaatgctagtagtattcagagtcctggaacttctacacagatactgcagatagttttgaaaaggtgtgaagacaaccagtctcggagcaatgatgattatcaagctgcagtagaaaggttaattatggctgctcgtatatcagatccaaagcttttcgttaaacacatgactgtcaatgttaataaggaacaggtttatagtttggaacattgttctgccctgaaatggttaaaagagaatatgaagtgggctggaaaggtttggcttttcagtaaccattagctaataaagtctgctttttttttttttttagttcaagtaatcattgttgaaaataaaaggcaataaaaatagacagttttcactata

SEQ ID NO: 6042 - DNA, 2013 bp, Homo sapiens
ctccctcccccaatcccccctccccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtgggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaactgtctg

SEQ ID NO: 6043 - DNA, 2581 bp, Homo sapiens
cggggcgcagagctgcgggtccgctttgtctccccggggcgccgcgcggtgcagtggggacggcgcggcgagcggggcgcccggggcgcgggtgcggggtgtcggggcgcgcgcgcctgttggccgctcgccgacggggcccagagccgccgattcctgccgagtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtgggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaactgtctgatttggctcatcattgaagaggcctagttttgaatgtcttctctggttcttgctaattcatgtgtttccagagccccagaagtcaggccagcaaacccaagggcaaatatcaaaagagagagaatcagctctgcctttcatgcgttttcccttttgaggattttatgagattaggggctaggcagtggctcattaagatggtatttgcagagctgcctctggacacaaagcagaattagaccaagatccttttatttctacactttttctcccttccaaggcattcccatacgcttcaaaacttactctttctcactccttgccattaagacccactctgtggtattctttaagacccactctgtggtattctttctttttccctgccaaaagagatctgacctcccttcttcatggaatatgtgcacttttcctcagacaaaaagcttaaacttttgtaagaggataaaaatttgagacagaa

SEQ ID NO: 6044 - DNA, 1468 bp, Homo sapiens
agaatgactgttgccagcatctagaaggaattacttttccaggcagtgcaatcatgctatttatcaaaagaaacattggacaatcagaatgggctgcagagctgtgtcctgagctgtctggccaactcccggcaagaagcttctttgtcctttaaagactgaactttatcctcaagcagtaacaggactggaatgaaaggagtttggaattattctgctttgagccgaagagaagatgaaacacgaacccagaggagcaggatgacagacagagtcccttgttccaaatgtttccaggttcactgccagatttctgttctgaattgtgtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttg

SEQ ID NO: 6045 - DNA, 704 bp, Homo sapiens
agtctggctcctaggcggctgcacagtggcagcaaggctggggcgctggctccgcgccagctccatcagaattagctcattgttcactagcaccctagcgggagagagagggaaagggagagagagagactcttagagaaagagagagacacacacactcttggagagagagcgcgaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtg

SEQ ID NO: 6046 - DNA, 2065 bp, Homo sapiens
actagcaccctagcgggagagagagggaaagggagagagagagactcttagagaaagagagagacacacacactcttggagagagagcgcgaggcagggagatgatctcctcctcctttttccaaggctgcacttcttggaagtgaagccggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtgggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgca

SEQ ID NO: 6047 - DNA, 2304 bp, Homo sapiens
actctgaggcattacactacacggtggaaggctgattcctattctgtcgtcttgattgcaaatatactgccagtagtatgtctgggaacaaagagcagccagaaaacaatctatttttatcacttggttctacttttaagttgctaaaccttttgaactcatgcaatttaaagatgaaccaaacactaagaatagcccaggactctgcaaagccaagtaccagggattcctttgtcccttagttaagcctataggccacttggaaagctctttcagaaatcccagtagttaacaataatttgcatgtaacttatcttaaccacagaaaatggttattcgtctgtaacctctaaagaggcatttttcgtttgctgacctgtggtgaggcgatgtgtctactgtatttaaacatattttgcaggttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtgggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 6048 - DNA, 636 bp, Homo sapiens
aggaagtcaactatccaccatcttgtcggatccatgcagtcttagcagactttcttcacaccatggatgattgaatccactactctttgcatgtttaaagacagagaaggcagattctctgcagagagacgtgaagagaaggttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttac

SEQ ID NO: 6049 - DNA, 559 bp, Homo sapiens
acactcttggagagagagcgcgaggcagggagatgatctcctcctcctttttccaaggctgcacttcttggaagtgaagccgagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagttttta

SEQ ID NO: 6050 - DNA, 698 bp, Homo sapiens
acgcgcagccacaggacctctgggcccggccttcaggggcgctccccgccccgggcttccccgcggaagggagtggggcgcgcgtacccagctgaggggcagggtccgacccgaggccgtgtgcaaatgcatccttcgcggactctttgtgtgtctgagcgcggctccgcgccgccgcaggcaccattttctgcttcgctcaggacaggcacataaaaggaaggcggctgccgcccgtcgccgtcctcttttcctcagatgccctctgctgcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggact

SEQ ID NO: 6051 - DNA, 311 bp, Homo sapiens
gcaggcaccattttctgcttcgctcaggacaggcacataaaaggaaggcggctgccgcccgtcgccgtcctcttttcctcagatgccctctgctgcaggtgtagagaggagagagagtgaacagggagcggggcttttgtctaaaatggttattcgtctgtaacctctaaagaggcatttttcgtttgctgacctgtggtgaggcgatgtgtctactgtatttaaacatattttgcaggttggtctccctggactgaagagagggagaatagaagcccaagactaagattctcaaaatggtttattaccca

SEQ ID NO: 6052 - DNA, 475 bp, Homo sapiens
acctctgggcccggccttcaggggcgctccccgccccgggcttccccgcggaagggagtggggcgcgcgtacccagctgaggggcagggtccgacccgaggccgtgtgcaaatgcatccttcgcggactctttgtgtgtctgagcgcggctccgcgccgccgcaggcaccattttctgcttcgctcaggacaggcacataaaaggaaggcggctgccgcccgtcgccgtcctcttttcctcagatgccctctgctgcaggtttattattacagtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaa

SEQ ID NO: 6053 - DNA, 540 bp, Homo sapiens
cggggcgcgggtgcggggtgtcggggcgcgcgcgcctgttggccgctcgccgacggggcccagagccgccgattcctgccgagtgtagagaggagagagagtgaacagggagcggggcttttgtctaaaatggttattcgtctgtaacctctaaagaggcatttttcgtttgctgacctgtggtgaggcgatgtgtctactgtatttaaacatattttgcaggttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcat

SEQ ID NO: 6054 - DNA, 587 bp, Homo sapiens
agacacacacactcttggagagagagcgcgaggcagggagatgatctcctcctcctttttccaaggctgcacttcttggaagtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaac

SEQ ID NO: 6055 - DNA, 557 bp, Homo sapiens
aaatgcatccttcgcggactctttgtgtgtctgagcgcggctccgcgccgccgcaggcaccattttctgcttcgctcaggacaggcacataaaaggaaggcggctgccgcccgtcgccgtcctcttttcctcagatgccctctgctgcaggtttattattacagtgtagagaggagagagagtgaacagggagcggggcttttgtctaaaatggttattcgtctgtaacctctaaagaggcatttttcgtttgctgacctgtggtgaggcgatgtgtctactgtatttaaacatattttgcaggttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctcc

SEQ ID NO: 6056 - DNA, 3135 bp, Homo sapiens
cagaacccaagggcttacctgtgctctgtgattccccaactagggatttagttgtagccacggacctggtaggcaacagggaggggattttaatctgctccttgcatcagaaggtccaataggcagggttagtataatgggagatgccctggtagggctggcaaggagaagaagccacatgtattttggtctgatgaaaagcagcagtgatctgtcactgaccaaaatggtcccccaactatgcattacggagcagcaacccacatacagaactcgagaagccacggcctggagactgtacctggacaccaaagactggagagaggagctggtggggaaaccccagagttcccagggtgccactccccagctccaccagagaactttgggaatgagctgctgcccctgagtgcccctctccagggcctcagtgagggtctctaccctccagggaggaacaaaaccttgccagctggggtcctgcgagagggggcagttcaattcctccacaggggactctgcaactccaatctttcgagtgaagcatctgcgaggccctcagggacccaggatgaactgcatagcagcagaaggaagacaggccagaccaggcgggagggagcccggaaacatctggtttgtagtttcagactctacccgttcacagttcacacagtctcaccgggaaactcacaccttgccctgtaccaagtttttaaggcagttaagctctgcccatccgagacttcatttttcttgagtagaaaatcactgaaatcatcagatccatggcacccaccttcactttctcctaacagctggaaccgtcaggctggcttcagggcctggtcttcgcacttgatatcactatccctcacctgctcagacagccagagcaggcgggtgagttcctcccaacaacctccactgcattctctcagctcccaccgcagggcagcccacgtgcctgagtgaacatgtgtgcgtgtgcacacacgcaagtatgcacagacatacactaaacacgaacatacagtgcacatgaacgctgctcccagctagggccctctggtcagactgctgcctgggttagaattcttgtccccacccccacttactatagttctgtgatcctggacaagtaactgaatctctccgtgccacagtttcttcttgtagaaaacgggaaagttcacagtacttacctccttagagtcattgtgaaggtcagtttgaggcatcacaaatttaaggcacccagacataagggtcaacagggttagctatcactgtccagtttggtgggaggaactgaatgcatgtaggcacatggacccagtctacactcaggcacaaaaggagctacattagttacattcaggcataccccagagcactacaattctctgagacattgtctggaaatctagaaatcatctccttgccctttaaggtattttaaccctcgcattcctctgcttttccaagaatgtgaatcttgccaagctgtccgtgagagacacgggctcccctcgagggagacttgcaaatgctccataaacagccacagtgtggggctctgccatgaggaagtcacagcagacacgctagacagcatagtcctggatgcaacctggaggaagggaggcccatggtggagcactcactccgtgcctgtctgcccggtgagacctcaagttccttgcagacaaaggccatgggttgttggctcttgtgttcccggtggcctttccagagctgaacagaggacagatgcacagacgggggggctctggtggtcaaggcagcagtccccttggatactaaagtctgagccaggcccctcaggcccggcatgggcagtgcgaggcccatagtggtgggaagccagttggccagctggggtgagaaggccgcgaagccatgggcagacaggaagtggaggtgaatgtctctgcctcctgtaggcctcagcagggacagcacagaccctctggctggggcagcgcagaccctctagctggggcagaacaaggctggtgcttccttctagtccttgagactttgtagctctaactcaagcagaaccctggggttttgggattctgtgtggtgactgctgaggaaggtttatggatttgacagggtgcatgtcacagagagacagttctcagtcagcacttcctgtcccctgcagaggctcataggggacagcccctgccaaggagaccctggaggggctctgaggatagcaatcagaggttgggctggctggactgagcccaggcctgttgcccaccaagtctccataggttctagtctgacccctctctccacccctgggctatgcaggccagcccgtgcagaccacccccgacgcgtccacttgcaacacccgcctcactgtgccaacactccatccacacaggaaaggactgagaacgtgatgcttaacccaaaggagtgagtttcataggatgggtggctttaacagtttcacagcaggacactgagggaatatttccctatcccttcaaatggacggtcactacagaaacgtgtagagcaagactttgtcaaggggctgtttccaggtctcccggtgtctaaatagcagagctggaatgggaactgagaaccgattctttccacaaccgcccactgagcagcaaggctgcagccagcaaagaggtgcggaggcaagcaagctccatgtggtggggacagcgcattgcgacctccaccacccctgcagtgggctgccagctgagccacctgtcttccactgtatctactgtacgaacttctccagctctgctctgttttctcttcctcagcatccaccccgtgacacgtagtggtggctgatgtcgccacagtaccatgaggttaacaggtcctccctccagcttccctcatggtggcagcctaacctgcattgcagccgttcaccggacaccgcaccagaccctcaaaacccatccaagactgtgggaggagtaaacaacccagcccagttaagaggagatgccgaatttaatgaaccctatttgaattgcagggctgtgattcctcttacctttaacgtgaactcacaggcggattaaagtgaaataaaacctaccatttgagtta

SEQ ID NO: 6057 - DNA, 792 bp, Homo sapiens
cggcttttccggggcccgggagccaaccgagggcgttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatgggggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 6058 - DNA, 903 bp, Homo sapiens
agcggcgggaggtaaggcatggccaggccggctgggctgcagagcgccggcacgggtccacgcctcgggtgacgggcttccaggatgttcgggcgcggggcggcccatccgcatcccccaacacccccacctccggcctgagcctcccagcgccgtgggaaccacctcctgtccgctgttgctggcccgcatcctagcagcggcctgacgccctccccaccctggcatgcccccttgacctgggacgatgagcatacgactggggagcccagtggaggcgccctcccgaagcgccactgcccatgctgaccacccagccctccggctgctgatgtcatgagtaacaccactgtgcccaatgccccccaggccaacagcgactccatggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatgggggcggctggtagacacctttgctttctctagccctcctgggctgggcttgggcacaaatc

SEQ ID NO: 6059 - DNA, 1297 bp, Homo sapiens
cacagacggaggccgagtgggcccggagcagggtcttgccgcgaagggcctgggctcaacgttagagcgtggcgcgaccctattctggctgcaacgagaggggtgaatgaagtgggcgccggggacctcccagaatcggagctccagacgcgggcgggccaggggccgccggaaaactgcgcgcgccccgccctaccccgtccggccccgcgtcgcgttctcctcccccactgcgcagccctcggctgccccctgccgccgccgggcggaccctgcaagccccgctgtccccgccttcgcaccgcccacccccgcctccggattggcggctccagaaatctccaggccaccggctttccgctaccggattggctgcgtccgggtgctgaggcccggcccatttccccgggtcctttgatcacgcgcctgacggcttttccggggcccgggagccaaccgagggcgttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatgggggcggctggtagacacctttgctttctctagccctcctgggctgggcttgggcacaaatccccaggcaggctttggagttgtttccatggtgatggggccagatgtatagtattcagtatatattttgtaaataaaatgttttgtggctaggggttttgatttca

SEQ ID NO: 6060 - DNA, 1053 bp, Homo sapiens
agcggcgggaggtaaggcatggccaggccggctgggctgcagagcgccggcacgggtccacgcctcgggtgacgggcttccaggatgttcgggcgcggggcggcccatccgcatcccccaacacccccacctccggcctgagcctcccagcgccgtgggaaccacctcctgtccgctgttgctggcccgcatcctagcagcggcctgacgccctccccaccctggcatgcccccttgacctgggacgatgagcatacgactggggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatgggggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 6061 - DNA, 891 bp, Homo sapiens
agaaagtactcaagacattcacggtgccccggtcagcactcgccatgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgctcaagaacaggactgctgggtttgacatctaccagccaggaagctttaggcagctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatgcacactttcatattccccatcacattggctgaagtcgtcctcaggcctcactcctatccatcaaagaagacaggactcaccttgctggctgctgccagcattgcttacatcagccgcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatggggtgacatgaggcagccacggaagaagaggaagtaattgcacaccattttccaagaaccaagaaagaagaaaacacaagagatttttctcatcttttttttttttttctggtggagggaggtggtggaggaacata

SEQ ID NO: 6062 - DNA, 1056 bp, Homo sapiens
gcattgctacctgcccttctcaaagcccacatgttgtattttatgcaaatctacagattatctatcattatctaaatgcaggcatctgaaaaccagcagtaatcctgcctctgaagtttatcaggaaaggagcttaaaagagaaccaaattcagcctgtgttggaactctcagtcccagaggggtgtggtttgtagctctccggcctgctgttggacttaggctgtgacccacagaaggacgccagaaagtactcaagacattcacggtgccccggtcagcactcgccatgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatgcacactttcatattccccatcacattggctgaagtcgtcctcaggcctcactcctatccatcaaagaagacaggactcaccttgctggctgctgccagcattgcttacatcagccgcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatgggtttctgttcagatcttgcaaagatggaggctagaatctgttggaatctgcttccagtggcccgattggaagtcaccagccaagcaccaactggtcaagaatatcaggtga

SEQ ID NO: 6063 - DNA, 991 bp, Homo sapiens
agtctccaaaccagagccaccattcttgcgaagtgagttcccacccacccgagagggagatccttagctcctcatcatcgccagtcatgatgatgagatactctggaagacatccattctgtggaaaccccacaaggtgaggccacgtctaaatagcttacagagtcttgctctttcacccaggctggagtgctgtggtgttatctcagctcactgcagtttcaagctcctgggctcaagtgatcttacctcagccttctgagtagctgggactccaggcatctgaaaaccagcagtaatcctgcctctgaagtttatcaggaaaggagcttaaaagagaaccaaattcagcctgtgttggaactctcagtcccagaggggtgtggtttgtagctctccggcctgctgttggacttaggctgtgacccacagaaggacgccagaaagtactcaagacattcacggtgccccggtcagcactcgccatgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatgcacactttcatattccccatcacattggctgaagtcgtcctcaggcctcactcctatccatcaaagaagacaggactcaccttgctggctgctgccagcattgcttacatcagccg

SEQ ID NO: 6064 - DNA, 1927 bp, Homo sapiens
gaaaagaaaagagactacagccatggaagtatttcgctagattttcctagtatttcatgcttacttcatttaaccatgcccctgccccagtgccctagtgaaacagtacaatgtacagctcttgcattgctacctgcccttctcaaagcccacatgttgtattttatgcaaatctacagattatctatcattatctaaatgcaggcatctgaaaaccagcagtaatcctgcctctgaagtttatcaggaaaggagcttaaaagagaaccaaattcagcctgtgttggaactctcagtcccagaggggtgtggtttgtagctctccggcctgctgttggacttaggctgtgacccacagaaggacgccagaaagtactcaagacattcacggtgccccggtcagcactcgccatgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatgcacactttcatattccccatcacattggctgaagtcgtcctcaggcctcactcctatccatcaaagaagacaggactcaccttgctggctgctgccagcattgcttacatcagccgcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatggggtgacatgaggcagccacggaagaagaggaagtaattgcacaccattttccaagaaccaagaaagaagaaaacacaagagatttttctcatcttttttttttttttctggtggagggaggtggtggaggaacatagcaaagtaggagggacagagagtgatacttaaatttaataagaggttcgtgaaggtagcttaacttgagaactcttggttttttgaaaggttgactgcacatgccaaaaacaactcctgctatctcagaattaattatctttgaccttcgtggaggatggtctctggttaaaatctggccaaagaaactcacataaacttggtgttagagaacatctagagagagagagaggaacttagagtcatttaaactcttcagtttacagagaaggatgctgaggacctagatgagaagttacctgcaaaaggcaaaagggttacttagtgtcagaaccaaggcaatgacttctctctcccagatctcctagctactggtcctgggccatttttttttttttaaataatcccaactttctttaaaagacaagcatttcagtaagctagttattttcatgggttgctcatccatttttttcagtgatctaaaaatgtagggagatggctactactgaagttgtctgtctacttgggataatagcaaattaattgaagacaatgggaaagtaagttataaaaaatactgggaaatctgtttctcttctgagcaagcattcagggcaggtataaacatcaaacatagtgacattgtcaaaacctcttccatttgaacattgattaattcatcaaataaatggtatagtaataaattttgcttgcagaagaa

SEQ ID NO: 6065 - DNA, 817 bp, Homo sapiens
acctgagtcagagcctagtccggcatgctgcctagcccagccacgtctcatcctattcatggcagagcggggactctcaccctctcccagcaatgtctaaagtcaggcatctgaaaaccagcagtaatcctgcctctgaagtttatcaggaaaggagcttaaaagagaaccaaattcagcctgtgttggaactctcagtcccagaggggtgtggtttgtagctctccggcctgctgttggacttaggctgtgacccacagaaggacgccagaaagtactcaagacattcacggtgccccggtcagcactcgccatgacgaagacttctacatgcatataccacttccttgttctgagctggtatactttcctcaattattacatctcacaggaaggaaaagacgaggtgaaacccaaaatcttggcaaatggtgcaaggtggaaatatatgacgctgcttaatctgctcttgcagaccattttctacggggtcacctgcctggatgatgtgctgaaaagaaccaaagggggaaaagacattaagttcctaactgccttcagagacctgcttttcaccactctggcttttcctgtatccacgtttgtatttttggcattctggatcctctttctctacaatcgagatctcatttaccccaaggtcctagatactgtcatccccgtgtggctgaatcatgcaatgcacactttcatattccccatcacattggctgaagtcgtcctcaggcctcactcctatccatcaaagaagacaggactcaccttgctggctgctgccagcattgcttacatcagc

SEQ ID NO: 6066 - DNA, 916 bp, Homo sapiens
gtgtaacctctcctgtttttgtacatgtgtttattcctgaactgttttgggctactcattgttaaccaggttgctgctctacttttcccactgctggctaaggaagattcaactttttcaggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttgggggg

SEQ ID NO: 6067 - DNA, 4418 bp, Homo sapiens
ggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgttggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacaccaaaaaaa

SEQ ID NO: 6068 - DNA, 4232 bp, Homo sapiens
ggaggcggaggcggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctgatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgttggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacaccaaaaaaa

SEQ ID NO: 6069 - DNA, 1128 bp, Homo sapiens
ctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccagctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtg

SEQ ID NO: 6070 - DNA, 1337 bp, Homo sapiens
gagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttgggtacgttggggctttgagcgagcctccccgcaccctcccataggaccccaggacagactgcgtcctcgctgacccgccctaggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaattt

SEQ ID NO: 6071 - DNA, 1515 bp, Homo sapiens
ccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccagctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtc

SEQ ID NO: 6072 - DNA, 819 bp, Homo sapiens
ctctttgccccagaagggttttgtattacgtcccaggggccgaacaaactcacattcatcgataaacgttggggaaaaaagcctattaagtggttgtacagggcaatcagaatattatatactaaggctgcctaagcatttttacttccttttcccttctcatagctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttg

SEQ ID NO: 6073 - DNA, 3330 bp, Homo sapiens
ggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaaagaaattaaaaattagctgggcctggtggtgcaggcctgtagttccagctactctagaggttgaggcgggaggatggcttgagcctgggaggttgaagttgcattgagctgtgattgtgccactgcactccagtgtgggcaacagagcaagaccctatctcaattaaaaaaaaaaatttggtggtggagtgggatggccacttttgtgtttttaacctccatagaagatttggatgtgcagccagctggggtctaaatattagtcctcttttcttccgaagctgcaaagaccagtcgtctattgtggtcatggtaggaaaataaagttcatggatttagccaatggttcagtatcagagctattcgggaaactagacattttcttgttttcccttacagtggtgttgagagttaaaacagccagacttgctattgattttctccctagagtgactttgggtctgtcacaggacttgctgctttcccaagtataaaagaacaactgtattttagaaggggctggttaaaacaccaggaaagtactggttaaatataatctttgtactttagactgtgttcttatcacatatcagcctgataagaggcaacagtttcaaaaaagtatttcacttttgtatttctaggtggaacagacaagttcttcatgttgttggggtaggggcagtggagggtcaagttcattatcaaacttttagattgaggcttttcttgaagcattgcttttgtccacataaagttgaagggaaaaaggaaggagagattatctaaatacacaaaattgaaagtgagagtgggggataagaaacttaaagaaacttaaaatattttgcttaactctgcaattacagatgctcctcaacttaggtctatgtctgggtaaccccatcttaagttgagttcagttgaagggtgtactgaatgtgtatggcttttgcaccgttgtaaagtccaaaaattgcaagacaaaccattgtaaattgagtaccatctgtaaaccttaacacaagtcaaaacatggattttctaggcttcctttacttttaaagagattatggttattattattatttttttcttggcgtttgagccttgattctttagacaaaacctagtctcattcaggattggctgtaagtggaattctgggacttagcaggaatgtgataaagcactttgtcatttgccgatagtagtcttgggtcaaattccgacgacttatcacacttgaagcctgaggaaaggaggcatgccctggtaatcagagtgaacacattattcctggaaacctagttagagtttggcaaacacccggaaattcacctgtgaatttttgcttccacataggactcaaacaaacctttaaaaaaaaaaaaagagagacttgacatcatcctgccattaccatcaaacaccatgtattgaatacttttaaatgattgtatatctgaacattaaactactacttttcacccgctcctctctaataaagaagctagttgcttattaa

SEQ ID NO: 6074 - DNA, 814 bp, Homo sapiens
gctttcctgattgcagttttggttgagaaggttgttcttccctgctgagatggctggctgacttcaccagtcaagaggcctgcaggatgaactggtcttaagtgtgagaaagatttagctatgtgatgatgtggaggaaggtgaagtactacaaatcaagagagcataaaaacaagaacagaaatatttcagcatgtgaacagtggactaaacaggaaaaaaagcttggggccacactactttctctcaaaatgtcagacaaagaaattcttctgcagactggtggaagcttgtaaggtcaggacgcagtggctcatgcctgtaatcccaacgttttgggagaacaagaagggaggatggcttgagcccaggagttccagctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaat

SEQ ID NO: 6075 - DNA, 2368 bp, Homo sapiens
gcggccgcccgccagagtgccagtggctccttggaggtcgagtccaaggacgtggcttgaagccgggagctggggcgccggagtccacgcaccggggatggaggcgctgggtgacctggagggaccacgcgcaccaggaggtgatgatcctgcaggaagtgcaggagagacccccgggtggctttcgagagaacaggtttttgtactgatatcggcagcttcggtgaacttaggttccatgatgtgctattctatacttggaccgtttttccccaaagaggctgaaaagaagggagccagcaatacaattatcggtatgatctttggatgttttgctttgttcgagttgctggcatccttggtatttggaaactatcttgtacatattggagcaaaatttatgtttgtagcaggaatgtttgtctcaggaggagttacaattctctttggtgtattggaccgagttccagatgggccagtatttattgctatgtgttttctagtgagagtaatggatgcagttagctttgctgcagcaatgactgcatcttcttctatcctggcaaaggcttttccaaataacgtggctacggtattgggaagtcttgagactttttctggactggggctaatactaggtcctcctgtaggtggctttttgtatcaatcctttggctatgaagtgccttttattgttctgggatgcgtcgttttgctgatggtaccactcaatatgtatattttacccaattacgagtctgatccaggtgaacactcattctggaaactgatcgctttacccaaagttggccttatagccttcgtcatcaactcactcagctcgtgttttggcttcctcgatcctactctgtctctctttgttttggagaagttcaatttaccagctggatatgtgggactagtattcctgggtatggcactgtcctatgccatctcttcaccactatttggtctcctaagtgataaaaggccacctctaaggaaatggcttctggtgtttggcaacttaatcacagccgggtgctacatgctcttagggcctgtcccaatcttgcatattaaaagtcagctctggctgctggtgctgatattagttgtaagtggcctctctgctggaatgagtataattccaactttcccggaaattctcagttgtgcacatgaaaatgggtttgaagagggattaagtacattgggacttgtatcaggtctttttagtgcaatgtggtcaattggtgcttttatgggaccaacgctgggtggatttctgtatgagaaaattggttttgaatgggcagcagctatacaaggtctatgggctctgataagtggattagccatgggcttgttttatctactggagtattcaaggagaaaaaggtctaaatctcaaaacatcctcagcacagaggaggaacgaactactctcttgcctaatgaaacctagtccgatggatcctggattgatacaaggttgagaaatgaatgctcctggccttaaacatcaccgtaggaagggtttttaaaattttacgcgcaaaactccgtggaccccgtgccagtgtcttggaagtgtcaacgtgtttttggatgatcctgtattgggctgtacttactgtgatactgaaaagctgtcctgctgaagcagctatatttgaaatattaagtatgaaaggagtaattaaaaacaagcaaaacaaaacaagacttagtttttaaatgaccaaacttgtccttaaagatgttgttattaactcgagttagttcttatttcctctgtttattttttattctaagtacactgattctgtgaatgtaccttttttattaacagggaaagaaatgaattaatttgatatgctctaaatacataaaggtgcttcaaaatatgtagaaacattactatgaaatcagtttttaaaagatatactttctctttgtcctgaggtttttcggtcttgttcaaaaggaagaattcttgcctgccatacagaaactctctagcactccctgaccttaagcttttctaaaaattctgtttgtgtgaaaagtacaagaataacaatacttacaacttccatttttgtaacctacgttcacttatgatctggatttataaacattacttggtataacgtttttcatttcctttaatgtctctgttttttggctctaccatctgttttgtttttgtttttatctatatcttggtagatgtatttcatccctagagcaggtcagcctccttcccctaatgcgaatgcttgttttgttagggaagggcttcctccaacttcgtgtgaaattgtgatgttgaagtgaataaatgtctattgtgtaactctca

SEQ ID NO: 6076 - DNA, 472 bp, Homo sapiens
tggaggtcgagtccaaggacgtggcttgaagccgggagctggggcgccggagtccacgcaccggggatggaggcgctgggtgacctggagggaccacgcgcaccaggaggtgatgatcctgcaggaagtgcaggagagacccccgggtggctttcgagagaacaggtttttgtactgatatcggcagcttcggtgaacttaggttccatgatgtgctattctatacttggaccgtttttccccaaagaggctgaaaagaagggagccagcaatacaattatcggtatgatctttggatttcaatttaccagctggatatgtgggactagtattcctgggtatggcactgtcctatgccatctcttcaccactatttggtctcctaagtgataaaaggccacctctaaggaaatggcttctggtgtttggcaacttaatcacagccgggtgctacatgctcttagggcctgtc

SEQ ID NO: 6077 - DNA, 1862 bp, Homo sapiens
ggccgggcggatcgctgcctgcagggagtcggggatgccaggttccagctgagcagcggccgcccgccagagtgccagtggctccttggaggtcgagtccaaggacgtggcttgaagccgggagctggggcgccggagtccacgcaccggggatggaggcgctgggtgacctggagggaccacgcgcaccaggaggtgatgatcctgcaggaagtgcaggagagacccccgggtggctttcgagagaacaggtttttgtactgatatcggcagcttcggtgaacttaggttccatgatgtgctattctatacttggaccgtttttccccaaagaggctgaaaagaagggagccagcaatacaattatcggtatgatctttggatttcaatttaccagctggatatgtgggactagtattcctgggtatggcactgtcctatgccatctcttcaccactatttggtctcctaagtgataaaaggccacctctaaggaaatggcttctggtgtttggcaacttaatcacagccgggtgctacatgctcttagggcctgtcccaatcttgcatattaaaagtcagctctggctgctggtgctgatattagttgtaagtggcctctctgctggaatgagtataattccaactttcccggaaattctcagttgtgcacatgaaaatgggtttgaagagggattaagtacattgggacttgtatcaggtctttttagtgcaatgtggtcaattggtgcttttatgggaccaacgctgggtggatttctgtatgagaaaattggttttgaatgggcagcagctatacaaggtctatgggctctgataagtggattagccatgggcttgttttatctactggagtattcaaggagaaaaaggtctaaatctcaaaacatcctcagcacagaggaggaacgaactactctcttgcctaatgaaacctagtccgatggatcctggattgatacaaggttgagaaatgaatgctcctggccttaaacatcaccgtaggaagggtttttaaaattttacgcgcaaaactccgtggaccccgtgccagtgtcttggaagtgtcaacgtgtttttggatgatcctgtattgggctgtacttactgtgatactgaaaagctgtcctgctgaagcagctatatttgaaatattaagtatgaaaggagtaattaaaaacaagcaaaacaaaacaagacttagtttttaaatgaccaaacttgtccttaaagatgttgttattaactcgagttagttcttatttcctctgtttattttttattctaagtacactgattctgtgaatgtaccttttttattaacagggaaagaaatgaattaatttgatatgctctaaatacataaaggtgcttcaaaatatgtagaaacattactatgaaatcagtttttaaaagatatactttctctttgtcctgaggtttttcggtcttgttcaaaaggaagaattcttgcctgccatacagaaactctctagcactccctgaccttaagcttttctaaaaattctgtttgtgtgaaaagtacaagaataacaatacttacaacttccatttttgtaacctacgttcacttatgatctggatttataaacattacttggtataacgtttttcatttcctttaatgtctctgttttttggctctaccatctgttttgtttttgtttttatctatatcttggtagatgtatttcatccctagagcaggtcagcctccttcccctaatgcgaatgcttgttttgttagggaagggcttcctccaacttcgtgtgaaattgtgatgttgaagtgaataaatgtctattgtgtaactctcatg

SEQ ID NO: 6078 - DNA, 1621 bp, Homo sapiens
agctgagcagcggccgcccgccagagtgccagtggctccttggaggtcgagtccaaggacgtggcttgaagccgggagctggggcgccggagtccacgcaccggggatggaggcgctgggtgacctggagggaccacgcgcaccaggaggtgatgatcctgcaggaagtgcaggagagacccccgggtggctttcgagagaacaggtttttgtactgatatcggcagcttcggtgaacttaggttccatgatgtgctattctatacttggaccgtttttccccaaagaggctgaaaagaagggagccagcaatacaattatcggtatgatctttggatgttttgctttgttcgagttgctggcatccttggtatttggaaactatcttgtacatattggagcaaaatttatgtttgtagcaggaatgtttgtctcaggaggagttacaattctctttggggaagtcttgagactttttctggactggggctaatactaggtcctcctgtaggtggctttttgtatcaatcctttggctatgaagtgccttttattgttctgggatgcgtcgttttgctgatggtaccactcaatatgtatattttacccaattacgagtctgatccaggtgaacactcattctggaaactgatcgctttacccaaagttggccttatagccttcgtcatcaactcactcagctcgtgttttggcttcctcgatcctactctgtctctctttgttttggagaagttcaatttaccagctggatatgtgggactagtattcctgggtatggcactgtcctatgccatctcttcaccactatttggtctcctaagtgataaaaggccacctctaaggaaatggcttctggtgtttggcaacttaatcacagccgggtgctacatgctcttagggcctgtcccaatcttgcatattaaaagtcagctctggctgctggtgctgatattagttgtaagtggcctctctgctggaatgagtataattccaactttcccggaaattctcagttgtgcacagtaagttacttccattgcttgaagagctgtattgtgaataagtagtaagtatcacaggctttcttgaatttctcaattttgcagcatgttggatatttttgccccaatgttaaatcttcatgattttgtagcatatgatattatgatataaatagtaataatacactaatagaaatgataatagtacattaatagctaaaatgggttgtggacagatgtctggcttggtttatgcctcagtatgtaagtaattttgaaaagctaaagcaaaatagataggtctcagcattgttcctctttcatggaggaggtccatgagagagcctagagtgaccagcatctgtcacctggtcatcattcttttgtttaataggcatgatgatgaagaacactaagtactatggctgtgctgggtcagttcaatagttctcatgggaataaggaactatctctgttttttaaaagttgcctttgttctctttccatcttcatctcattttaagaatttcttaattatatatttttataagtatttaatgcaaatgagccatgcttcttaatatcatatatatatgcag

SEQ ID NO: 6079 - DNA, 1018 bp, Homo sapiens
tcggcctttgggtttgctgtggtgtccttgtctcctgcaggaccggccgcagcatggacgctcccaggcggtttccgacgctcgtgcaactgatgcagccaaaagcaatgccagtggaggtgctcggtcacctccctaagcggttctcctggttccactctgagttcctgaagaatccgaaggtagttcgccttgaggtttggctggtggaaaagatcttcggccggggcggagaacgcatcccgcacgtccagggtatgtcccaaatcttgattcacgtgaatcgattggaccctaacggcgaggctgagatcttggtatttgggaggccttcttaccaggaggacacaatcaagatgatcatgaacctggctgactatcaccgccagctccaggcgaaaggctcaggaaaggccctcgcccaggatgtcgccactcagaaggccgagacccagcggtcttcaatagaagtccgggaggccgggacgcagcgttcggtggaggtccgggaggccgggacccagcgttcggtggaagtccaggaggtcgggacacagggttctccggtggaggtgcaggaggccgggacccagcagtctctccaggctgccaacaagtcggggacccagcgatcccccgaagctgccagcaaggcagtgacccagcggtttcgcgaggatgcccgggacccagttactagattatgaaggcatctcaggccctggagccagagccagtcaggggttaaagtgaaagcccgtatttccgcccagaagctggggttggggagaggatgtggattttttgttttaccctttctgttgcatggttgcaaacacaaacttgagttctaataaagaattgcaaagtggaagcccgccccccgcctcccccccgcctcacttaagtccaggaagctggggtggcgaggaaggatgatgtggattgtttttgttttacaccttctgttgaatggttgccaacacaaacttgagttctaataaataattgcatttcc

SEQ ID NO: 6080 - DNA, 1719 bp, Homo sapiens
agttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgagaatggagatccagttcgcccaggagtagctatgactgatcttgccactggcctgtatgcatatggagctattatggctggattgatacaaaaatacaaaactgggaaaggactgttcattgattgtaacctactgtcatcccaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcagaacgctgtctctggcttccaaagcctgctgcattccttggcccatggccccttccttcatcttcaaggatcagcaagggtattacacaatggcctcgttatggagatggagcatccaactgtggggaagatttccgtcccaggcccagctgtgagatacagtaagttcaagatgtcagaggccaggccgcccccgctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctgg

SEQ ID NO: 6081 - DNA, 1645 bp, Homo sapiens
gttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgagaatggagatccagttcgcccaggagtagctatgactgatcttgccactggcctgtatgcatatggagctattatggctggattgatacaaaaatacaaaactgggaaaggactgttcattgattgtaacctactgtcatcccaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcaggtattacacaatggcctcgttatggagatggagcatccaactgtggggaagatttccgtcccaggcccagctgtgagatacagtaagttcaagatgtcagaggccaggccgcccccgctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctggtattaatgaatctagtgccttttaaatgtatcccacgttttgttccctaccatcttttttttcagatgatgatttcattatggatttgtgggatttttaaaaataaagttttaatttttttcctggaaaaa

SEQ ID NO: 6082 - DNA, 1217 bp, Homo sapiens
gatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagagaaggggttttcccatgttgcccaggatggtcttgatctccaaacctcaagcaatctgccggctctggtctcccaaagtgctgggattacaggaatgagccaccgcgcctggccaacttcctgaattatcgttgtctccacacctgcttacagtgctgttcctcaggtatcaaagcatcccagcatgttgtgcctttctccccatcctcctctactttctcctctgttgtgtactggtaactcggaatctctgaatggctgtagaaacagaaaagtggatgggactgatggaaaacccaaatttgggtttcagaaagctatctgttgtttgacatgcagtctagaattaatgactataccaggttacccttggaacatcttgcatttgtgggcagaaacatttggctacttgccacggggttatcctgaaaaaagatgggcttgaaaaactgtcactagtgtcacttgaattggtcatccatggttggggagttccattccaagaggataatttacacaatttaaaataaagggggccaggtgtggtggctcacacctgtaatcctagcgctttgggaggccaaagcaggtggaatccttgaggtcaggagtttgagatcatcctggctaacatggtgaaaccctgtctctactaaaaatacaaaaattatctgggcatggtggtgtgcacctgtaatcccagtttttgggaggctgaggcaggagaatca

SEQ ID NO: 6083 - DNA, 1369 bp, Homo sapiens
gttcgccgcttgcaccgggaccgatgccatctgagacgcacgcgatgctggcgacgctggcgagggtggcagctctgcgcagaacctgcctcttctccggccggggcggcgggagggggctgtggactggccgcccgcagtcagatatgaacaatataaagccattggaaggggtaaaaattctggatctaacaagagtcctggcgggaccttttgctactatgaatttaggagatcttggagcagaagttataaaagtggagagaccaggagctggtgatgatacacgaacttgggggccaccttttgttgggacagaaagtacatattatctcagtgttaaccgaaataaaaaaagtattgctgttaatatcaaggatccaaaaggggtgaaaatcatcaaagagcttgcagctgtttgtgatgtgtttgtggaaaactatgtccctggcaaactgtctgcaatgggcctgggatatgaagatatagacgagattgctcctcacatcatctattgttccatcacagggtatggtcagacaggtccaatttctcagcgagctggttatgatgctgttgcctcggctgtttctggtctgatgcacatcacagggcctgaggtggcgtgtttgtctcacatagctgcaaattatcttattggtcaaaaggaagcaaaacgttggggtacagctcatggcagtatcgttccttaccaggcttttaaaaccaaggatggctatattgtagttggagcaggaaataaccagcagtttgccaccgtctgcaagatcttggatttgcctgagttgattgataattccaagtataaaactaaccaccttcgggtacacaatagaaaagagcttattaaaatattatctgaacggtttgaagaagaactgaccagcaagtggttatatctttttgaaggcagtggagtcccgtatggcccaatcaacaacatgaagaatgtatttgcagaacctcaggtattacacaatggcctcgttatggagatggagcatccaactgtggggaagatttccgtcccaggcccagctgtgagatacagtaagttcaagatgtcagaggccaggccgcccccgctgctcgggcagcacacaacgcacatcctgaaggaggtcctgagatacgatgacagggccatcggggagctgctcagcgctggagtggtggaccaacatgaaactcactgacaaaggaaaagggctcttcctcataacctcgatccgaatacactggcaaaggcaacactttgcttggacccttctccccagttctgataccactaaaaagaagatttagagtaactccagatttcttacatggcatctccagaatggctctg

SEQ ID NO: 6084 - DNA, 948 bp, Homo sapiens
tggtaaaggactagcagttctctgcggagggccggttgatacagttccggtgggagaacgcggctgcgaggttttcggctttggctcctgatatgcagcgacagaattttcggcccccaactcctccttaccctggtccgggtggaggaggttggggtagcggaagcagcttccggggaaccccgggcgggggcggaccacggccgccctcccctcgagacgggtacgggagtccgcaccacacgccgccgtacgggccccggtctaggccgtacgggagcagtcactctccgcgacacggcggcagcttcccggggggccggttcgggtctccgtcccctggcggctaccctggctcctactccaggtcccccgcggggtcccagcagcaattcggctactccccagggcagcagcagacccacccccagggttctccaaggacatctacaccatttggatcagggcgtgttagagaaaaaagaatgtctaatgagttggaaaattatttcaagccttcaatgcttgaagatccttgggctggcctagaaccagtatctgtagtggatataagccaacaatacagcaatactcaaacattcacaggcaaaaaaggaagatacttttgttaacatttctgaaattcaactggaagcttcatgtgtcaggaacatcttggacaaaactttaagttgtgttgatataaatttacccaaagatgatgactttgattggataattagtaaggtctttttgttatttttcatcgtatcaggtattgttgatattagagaaaaaagtaggataacttgcaacatttagctctggaagtacctaccacattttagagatttaccgtttccatatatttaacattcctggttacataatggacatttgtcttttaatgttttttcaatgttttaaaataaaacattttgtcttcta

SEQ ID NO: 6085 - DNA, 1474 bp, Homo sapiens
gtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggttaaagactcagtctctgagaaaacaattggactgatgcgaatgcagttttggaaaaaaactgtggaagatatatactgtgacaatccaccacatcagcctgtggccattgaactatggaaggtctgcacaccagcagaggcaggcccagtttctgggccccagattgacttcacagagccccagtaaagatggaaagccagaaccccccaactggggattgagaagaaaaagtggatgggaagctgctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggaaattaaggatgcagacactcagggcgtgtgtcttgcacagccagccagcctgggaaaatgaagccaactgggagagagatttgaaggactctggttctaggcatgcgcacttctccaggtacttgagcttggaaaccttcttgcttaactagctctaggccaatcttgcttcactcgaacacgcacacacttctccttgcgctattttgaattaccagaggagaatctttgacaaacacaggtcgatgttagtgtgagccagactgggcaactacacaaaatcaaaatcaggaaaggagagccactttgctggaatctcccagaaggctggtggggtggactccggggctttgaaatctctaaagagtggtgactcacctctcctagaaattgccctggttatatcataaaagggctcaatttttacatgaggtctcaatggtctttttacttaatgtgacatcattagaaaaatcaacctttgaccagaaagaggcagttccctccttcctcacacaattcacaattttctgg

SEQ ID NO: 6086 - DNA, 1798 bp, Homo sapiens
gaagggcacgcagtgccggcgtcatggcggcctccgcgcacggctctgtctgggggccgttgcggcttggcatccccggcctgtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggcattgatgttaattctagtctattagttttataaaagttaggattcttatttaggaacaacaggaaatgactgttaaggagaaaatgaatttattgaatgggatgtcaagtagctcacaaaattgagaagttgccgtgggactagggtgccaagactgctgagattctggcagaggcactgccattggcacccctggcccagacagtgtctgctgtgctgtccctggaagctggagctccaacagggaatattggtgtagctgtgcataggccataagccacacttgagccagtgggcagggagaaggaatgtcattctcccttcaccactggggaaggaaaggggaaagggctcaagttatcataggggcttacatgctgagcagctataacctaggtgttcagaacacctggaagatgcatttatttaggggtcacaaatagtgaaattaatatttgaggaatatcagtcacgtgttgtgggcttttatccttaacgtttaatttttacaatcttgtgtaaaaatttatccatgataataacataacttctttaaggttggagtggctggcaagagcagagccttaatttgactttagctctggctggtctggaagcttttacttttttgttaatcccacttcctcactctgtcattcagcattatcatgatcgtgaacaaaattgtactgagaaagtttgtataagtgatatgaacggtattgtattgaacatccattaaagggttgctacacttta

SEQ ID NO: 6087 - DNA, 860 bp, Homo sapiens
atgccaatcagcatttcacattcctcatggttggttcaaaggaaacgggattatgaaggttatttatgctccctgctgctccctgcagaatcccgaagctctgtttttgcactgagggcctttaatgtggaactggctcaggttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggc

SEQ ID NO: 6088 - DNA, 1833 bp, Homo sapiens
aatgatttcactacagactctctggaaagcctgggagctgaattccggaagatccccacatcgatgaaagcaaagcgaagccaccaagccgtcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagaggatggataaggacgttatccaagaatggacattcaaagaccaagtgagtttgtgagattctaacagatgcagcattttgctgctaccttacaagcttctcttctgtcaggactccagaggctggaaagggaccgggactggaaagggaccaggactgaacagactggttacaaagactccaaacaatttcatgccctgtgctgttacagaggagaacaaaatgctttcagcaaggatttgaaaactcttccgtccctgcaggaaaggattgatgctgatagaagagcctggacagatgtaatgagaactaaagaaaacagatggctggagatgacatttatccagggtcactttgtcaggccctaggacttaaatcgaagttgaacttttttttttttttttaaccaaatagataggggaagggaggagggagagggaggacagggagagaaaataccatgcataaattgtttactgaatttttatatctgagtgttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaaaaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaataataaattattgtaaactttgtggcttttggtctgtgatgcttggtctcaaaggaaaaaataagatggtaaatgttgatatttacaaacttttctaaagatgtgtctctaacaataaaagttaattttagagtagttttatattaattaccaaactttttcaaaacaaattcttacgtcaaatatctgggaagtttctctgtcccaatcttaaaatataaaatatagatatagaagttcatagattgactccttggcatttctatttatgtatccattaaggatgagttttaaaaggctttctcttcatacttttgaaaaatttcttctatgattacagtagctatgtacatgtgtacatctatttttcccaagcaatatgttttgggtttagagtctgagtgatgaccaagattctgtgtgttactactgtttgtttaataggaacaaatatagaaataatattatctctttgcttatttcccgttaaaactataataaaatgtttctagg

SEQ ID NO: 6089 - DNA, 3843 bp, Homo sapiens
gccgcgaggagggccccattcaaaagtagtcgctattgtcgccgtgggctgagctcgccgggccggcccctccgtggggccgcgctgggacgcacgcgggtggacgaggggaccgatcccgggcgcccatggccggggccgccatggccgagcggggccgcgtgcctccccccgcacccgcgcccagcacggaggggctgccgcgcgccttcctgcagagcctgcgcaccctgttcgacatcctggacgaccggcggcgcggctgcgtgcacctgcgcgagatcgagtcccgctggcagggcaccgacgcgcgggagctgccccgcggggtgctggagggcttgcgccaggtggccccggccagcggctacctgaccttcgagcgcttcgtggccggcctgcgcacctccctgctgagcgccgacggcggcccccgggaccccacgcgcgccccggcccggcccggggatcagccgccgccgccgccgcagcgcctggtgttcgctccggccgacgagccgcggacggtcctggagaggaagcccctgcccctgggcgtgcgcgcccctctggccggtcccagcgccgccgcccgcagcccggagcagctgtgcgccccggctgaggcggcgccctgccccgcggagcccgagcggtcccagagcgcggcgctggaaccgagctccagcgcggacgcaggtgcagtggcgtgcagggccctggaggcggactcaggggatgcccggcgggctccccgtgcccgaggggaacgtcggaggcacaccatcgccagcggcgtggactgcggcctgctgaagcagatgaaggagctggagcaggagaaggaggtgctgctgcagggtttggagatgatggcgcggggccgcgactggtaccagcagcagctgcaacgagtgcaggagcgccagcgccgcctgggccagagcagagccagcgccgactttggggctgcagggagcccccgcccactggggcggctactgcccaaggtacaagaggtggcccggtgcctgggggagctgctggctgcagcctgtgccagccgggccctgcccccgtcctcctccgggcccccctgccctgccctgacgtccacctcacccccggtctggcagcagcagaccatcctcatgctgaaggagcagaaccgactcctcacccaggaggtgaccgagaagagtgagcgcatcacgcagctggagcaggagaagtcggcgctcattaagcagctgtttgaggcccgcgccctgagccagcaggacgggggacctctggattccaccttcatctagtccttgtgggccgcgtgggcccccagggccagcctggcactcagcccttcgagggtgggcgccccatcgcacccaccctctctggctggagacccccggcaggcccaggcacagtcccggagtgggcgccttcctgccgcccttgccagatgggctccccaggcctgcccccggctggtccccgcaccgagcgcttgactccgttttggctcctggtgctgacatgggctggggctctcttgagtccgcatagtccgcagctactactgccgctgtcagtggacagtggggtacccctccatgagttagcgtccccccgtttccagcggtgccgccctgggtcccatcttcagggaaaggcactgcccacgccaggctgcacttccaacaacgggcagcagagggcgcggggcggctccgacgcgggtccaagggcagcttcccgctcaaccagggcaccaggacgaggtggctgtagctcggacggacggaagtagatggagggggtggggacggcctgtaagcggggggtgcctgcctggctggggagccccagggatagcggtcggacttcaggttctggccaaggctgagggaccctggctgcagcggatcggcacgccgggtgggcgagagcttggcctgcatgtgcctcccacagaccctggggtgatggccttccccctcttggccgggacgttgccccacgttgagtcccacacaacatcctgtgagcctggctccccaggagggcccccagacagctcccaggcacgtcataggcaaagcctgttcccccgactcaggatttccaaggcctggggtcctgctcacccccctttgctctcacgcccagcctgtccccaggtttcagctgggagaggccacctccctcagccaaggaaaacgagaacccccagggtacaggaggaggctggggcaggtccccttgggtgtcactccctcagcccctgcccaggcccactcccgctggtgctggagtacgcactggtgggggggccctgctcagcccaacctggagggtcccagtgtcaccagaaccaggggcacggcaacagcatcgatgggttctgcagcccagggcccccgatgcggggtcagtgcgtggggggcgcagggcccccgatgccgatgcggggtcagtgtgtgtggggcgcagggcctccgatgcggggtcagtgcgtggggggcgcagggccccctcgtgtccagggcactttggtacactgtcccacaaggcacctgtctcagaggaggggccctggcaggcagcgtggcaactcccttccggagcccagctccatgctaacctgcccacagcaaccccacagagccacattccctgctgcacctggtctgcaggggtgtcccaggacaggcccaagtcagcccagcatgcagctgccctcctaccctgaagatgggagtgggctttccaggggacataaggatgtcaggcctggacctcctgggcaggaaagggtgcaggtcctgagggcctgtgccccacagccccagcaccaggtggactgcagcgcagtgggtgggccagtggcagccagggagaagccccccgtcagcaggctggggtctgcccaccagggcctccccacgtctgcctttgagggtgcctgccatgccctgggggatcctggcatctttactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaagaaataggtcctcccagtttacagcttgaaatcaggctagtgagtggccctggagaccacgaggggagaatttaaaggccccggctggcagggtctaggtggctggcagaggcacatgcagaccctgcctggagcctgccctaggacgctgggcgggtcagtctccgtgcaggatgtgagcagcgtccctgggctctatccgcgaggtgccagtagcgtgtgcaggtacatacacgtgcgtgcacactgtgatgacacccggaaatgtctcaggatgttgaaatgtgtccttgggggcagaagtgtccccagttgagaatctgccccagaggaacacacccacaccaggcctcaggattttgtgttgatcaagttccaaggaaaaggaacatctcagccgggcgtggtggttcacgcctggaatcccagcacttgaggccaggagttccagagcagcctgggcaacgcagtgagagaccccatctctacaaaaaaaaaaaagaaagaaagaaaatgagagatccaggtttaaaaattcataaacaccacaaggaaacaatacactatgagacccagcagaagcaacagattgactctagacccagatactagaattatcagagagaatataaagtaacagtgttttatatatctaaagaaataaaagagatttctggaaacatg

SEQ ID NO: 6090 - DNA, 1603 bp, Homo sapiens
atgcgcagaccgaggcagggaggcgggggtgcgggaggctccgcggctgcgcgggcgcgtgctggtggcctcggcggaggctcagtcccggcccgcgcccgcggcgcccccgctgcggcccgagcggcctggctgcgggatctgtgcgcacggatggcgcggccgccccggcagcacccgggggtctgggcgtcgctgctcctgctgctactgacggggcccgccgcctgcgcagccagccccgcggacgacggtgcgggcccggggggccggggaccccggggacgcgcgcggggggacacgggcgccgacgaggcggtgccgcgccacgactcctcctacggcaccttcgcgggggagttctacgacctgcgctacctgtcggaggagggttaccccttccctactgctcctcctgtggatccatttgccaaaatcaaagtggacgactgtggaaaaactaagggatgctttagatatggcaaaccaggctgtaatgcagagacctgtgactatttcctcagctaccggatgataggggctgatgtagaatttgagctgagtgcagacacagatggttgggtagcagttggattctcttcagacaagaaaatgggtggtgatgatgtcatggcctgcgtccatgatgacaatggcagggtccgcatacagcacttctataatgtaggccagtgggcaaaggagattcagagaaaccctgccagagatgaagaaggagtttttgagaacaatcgcgtcacctgcagatttaaacgccctgtgaatgttcccagagatgaaacaattgttgatctgcatttgagttggtattatctgtttgcttggggtccagccattcagggctctatcactcgacatgatatagactcaccgccggcttcagagcgtgttgtcagtatttacaagtatgaagacatttttatgccatcagctgcctatcaaaccttctcatctccattttgtttgcttctgattgttgctctgaccttctacctattgatgggaaccccctaaccacagctgcagggccaacagattacatggattgggaagtctttagtataaatatattttttaaagaatatccagtataattttagcttcaattatttaagaaaaaaaacctcatataatttcagctttttggaagaaagaacaagcttcttttgtagtcaaagaagattgtttaataatgaccctatacttttggaacatacttacaccttttctaagcactttcacatatgttttcttatttaacttcacaacatctctgagttggattgatgaaaattgtgattgccatcttcctgaatgggatttgagacccaaaaagactgcctttttatgatccacataccatataactttggctagaaatgacaaatagaaaggcagagaaggaactaagtatagaaatcatgtctcaaaacagtctttactatgagtgctatagcacagagagttattttgaatattactagggagaactttactgaatgtcataagttcacagtcagccttttgggcagaagaaatttcaaatttccgtaaagcagaagtgcttttggatatttacaca

SEQ ID NO: 6091 - DNA, 2688 bp, Homo sapiens
gctaatatgctccctctcccacaaggcagcgcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacattgcggccggcgtgtggatgatgatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagtgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggtttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctccttgtttgttcctctgtgttctgtgtgcgtcttaagcaataaagcgtggccgtggctcgcgtgcctgccctctgctcccttctgccttggtgcctgtgtgtgagtgtggaagccaggcaggagccgctggcccaggaaataactac

SEQ ID NO: 6092 - DNA, 2794 bp, Homo sapiens
acaaggcagcgcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacattgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagtgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggtttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctccttgtttgttcctctgtgttctgtgtgcgtcttaagcaataaagcgtggccgtggctcgcgtgcctgccctctgctcccttctgccttggtgcctgtgtgtgagtgtggaagccaggcaggagccgctggcccaggaaataactac

SEQ ID NO: 6093 - DNA, 356 bp, Homo sapiens
gctggaggccaaatgctgactgcagcaggaagcacagccgagctgtcagcttgcgcgatctctggcctcttcaactgcatcaccatccaccctctgaacattgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaa

SEQ ID NO: 6094 - DNA, 1252 bp, Homo sapiens
tccctctcccacaaggcagcgcgccggctcggacgcggccggctaccgagccctttgtgagggctgtgagctgcgcctgacggtggcaccatgagcagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacattgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggccc

SEQ ID NO: 6095 - DNA, 1033 bp, Homo sapiens
aggcagcgcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacattgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaaagcccagactgaggctggttccttcgcagcccagcatcccagggagcctgggccattctcagaggggacaagacaggcctttgccaccccagcagttgtctctggggaaatcagaatgcctgcaggggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacct

SEQ ID NO: 6096 - DNA, 1277 bp, Homo sapiens
gtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacattgcggccggcgtgtggatgatgatggcggtcgttcccatcgtcatcagcctgaccctgaccacgctgctgggcaacgccatcgcctttgctacgggggtgctgtacggactctctgctctgggcaaaaaagcccagactgaggctggttccttcgcagcccagcatcccagggagcctgggccattctcagaggggacaagacaggcctttgccaccccagcagttgtctctggggaaatcagaatgcctgcaggggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagt

SEQ ID NO: 6097 - DNA, 777 bp, Homo sapiens
tctcttttgggggcggggtctagcaagagcagatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaagtaagaatttttcttttcataaaagctggatgaagc

SEQ ID NO: 6098 - DNA, 1873 bp, Homo sapiens
acgtaacctacggtgtcccgctaggaaagagaggtgcgtcaaacagcgacaagttccgcccacgtaaaagatgacgcttgatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaagtaagaatttttcttttcataaaagctggatgaagcagataccatcttatgctcacctatgacaagatttggaagaaagaaaataacagactgtctacttagattgttctagggacattacgtatttgaactgttgcttaaatttgtgttatttttcactcattatatttctatatatatttggtgttattccatttgctatttaaagaaaccgagtttccatcccagacaagaaatcatggccccttgcttgattctggtttcttgttttacttctcattaaagctaacagaatcctttcatattaagttgtactgtagatgaacttaagttatttaggcgtagaacaaaattattcatatttatactgatctttttccatccagcagtggagtttagtacttaagagtttgtgcccttaaaccagactccctggattaatgctgtgtacccgtgggcaaggtgcctgaattctctatacacctatttcctcatctgtaaaatggcaataatagtaatagtacctaatgtgtagggttgttataagcattgagtaagataaataatataaagcacttagaacagtgcctggaacataaaaacacttaataatagctcatagctaacatttcctatttacatttcttctagaaatagccagtatttgttgagtgcctacatgttagttcctttactagttgctttacatgtattatcttatattctgttttaaagtttcttcacagttacagattttcatgaaattttacttttaataaaagagaagtaaaagtataaagtattcacttttatgttcacagtcttttcctttaggctcatgatggagtatcagaggcatgagtgtgtttaacctaagagccttaatggcttgaatcagaagcactttagtcctgtatctgttcagtgtcagcctttcatacatcattttaaatcccatttgactttaagtaagtcacttaatctctctacatgtcaatttcttcagctataaaatgatggtatttcaataaataaatacattaattaaatgatattatactgactaattgggctgttttaaggc

SEQ ID NO: 6099 - DNA, 3200 bp, Homo sapiens
gcgcaggcggtggcgagtggatatctccggagcatttggataatgtgacagttggaatgcagtgatgtcgactctttgcccaccgccatctccagctgttgccaagacagagattgctttaagtggcaaatcacctttattagcagctacttttgcttactgggacaatattcttggtcctagagtaaggcacatttgggctccaaagacagaacaggtacttctcagtgatggagaaataacttttcttgccaaccacactctaaatggagaaatccttcgaaatgcagagagtggtgctatagatgtaaagttttttgtcttgtctgaaaagggagtgattattgtttcattaatctttgatggaaactggaatggggatcgcagcacatatggactatcaattatacttccacagacagaacttagtttctacctcccacttcatagagtgtgtgttgatagattaacacatataatccggaaaggaagaatatggatgcataaggaaagacaagaaaatgtccagaagattatcttagaaggcacagagagaatggaagatcagggtcagagtattattccaatgcttactggagaagtgattcctgtaatggaactgctttcatctatgaaatcacacagtgttcctgaagaaatagatatagctgatacagtactcaatgatgatgatattggtgacagctgtcatgaaggctttcttctcaatgccatcagctcacacttgcaaacctgtggctgttccgttgtagtaggtagcagtgcagagaaagtaaataagatagtcagaacattatgcctttttctgactccagcagagagaaaatgctccaggttatgtgaagcagaatcatcatttaaatatgagtcagggctctttgtacaaggcctgctaaaggattcaactggaagctttgtgctgcctttccggcaagtcatgtatgctccatatcccaccacacacatagatgtggatgtcaatactgtgaagcagatgccaccctgtcatgaacatatttataatcagcgtagatacatgagatccgagctgacagccttctggagagccacttcagaagaagacatggctcaggatacgatcatctacactgacgaaagctttactcctgatttgaatatttttcaagatgtcttacacagagacactctagtgaaagccttcctggatcaggtctttcagctgaaacctggcttatctctcagaagtactttccttgcacagtttctacttgtccttcacagaaaagccttgacactaataaaatatatagaagacgatacgcagaagggaaaaaagccctttaaatctcttcggaacctgaagatagaccttgatttaacagcagagggcgatcttaacataataatggctctggctgagaaaattaaaccaggcctacactcttttatctttggaagacctttctacactagtgtgcaagaacgagatgttctaatgactttttaaatgtgtaacttaataagcctattccatcacaatcatgatcgctggtaaagtagctcagtggtgtggggaaacgttcccctggatcatactccagaattctgctctcagcaattgcagttaagtaagttacactacagttctcacaagagcctgtgaggggatgtcaggtgcatcattacattgggtgtctcttttcctagatttatgcttttgggatacagacctatgtttacaatataataaatattattgctatcttttaaagatataataataggatgtaaacttgaccacaactactgtttttttgaaatacatgattcatggtttacatgtgtcaaggtgaaatctgagttggcttttacagatagttgactttctatcttttggcattctttggtgtgtagaattactgtaatacttctgcaatcaactgaaaactagagcctttaaatgatttcaattccacagaaagaaagtgagcttgaacataggatgagctttagaaagaaaattgatcaagcagatgtttaattggaattgattattagatcctactttgtggatttagtccctgggattcagtctgtagaaatgtctaatagttctctatagtccttgttcctggtgaaccacagttagggtgttttgtttattttattgttcttgctattgttgatattctatgtagttgagctctgtaaaaggaaattgtattttatgttttagtaattgttgccaactttttaaattaattttcattatttttgagccaaattgaaatgtgcacctcctgtgccttttttctccttagaaaatctaattacttggaacaagttcagatttcactggtcagtcattttcatcttgttttcttcttgctaagtcttaccatgtacctgctttggcaatcattgcaactctgagattataaaatgccttagagaatatactaactaataagatctttttttcagaaacagaaaatagttccttgagtacttccttcttgcatttctgcctatgtttttgaagttgttgctgtttgcctgcaataggctataaggaatagcaggagaaattttactgaagtgctgttttcctaggtgctactttggcagagctaagttatcttttgttttcttaatgcgtttggaccattttgctggctataaaataactgattaatataattctaacacaatgttgacattgtagttacacaaacacaaataaatattttatttaaaattctggaagtaatataaaagggaaaatatatttataagaaagggataaaggtaatagagcccttctgccccccacccaccaaatttacacaacaaaatgacatgttcgaatgtgaaaggtcataatagctttcccatcatgaatcagaaagatgtggacagcttgatgttttagacaaccactgaactagatgactgttgtactgtagctcagtcatttaaaaaatatataaatactaccttgtagtgtcccatactgtgttttttacatggtagattcttatttaagtgctaactggttattttctttggctggtttattgtactgttatacagaatgtaagttgtacagtgaaataagttattaaagcatgtgtaaacattgttatatatcttttctcctaaatggagaattttgaataaaatatatttgaaatttt

SEQ ID NO: 6100 - DNA, 713 bp, Homo sapiens
agcgcagcgggggcgggaaggttgtagtgccgcgagttgagctcctcttgcctaagtggtcgcgccccctttaagagcagcgattgtaaggagaggcggtcccggtgtcctcgggtcccaggttttcaaaacaaaaatagagttgcaatcttggcagaactggacaaagagaaaagaaaactacttatgcagaaccagtcttcaacaaatcatcctggagctagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatg

SEQ ID NO: 6101 - DNA, 874 bp, Homo sapiens
ggggtttccgctccctggggcgcacgtcagtcaggaggcggaagcgcagcgggggcgggaaggttgtagtgccgcgagttgagctcctcttgcctaagtggtcgcgccccctttaagagcagcgattgtaaggagaggcggtcccggtgtcctcgggtcccaggttttcaaaacaaaaatagagttgcaatcttggcagaactggacaaagagaaaagaaaactacttatgcagaaccagtcttcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatcc

SEQ ID NO: 6102 - DNA, 1425 bp, Homo sapiens
ggaagcgcagcgggggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaaggttttcaaaacaaaaatagagttgcaatcttggcagaactggacaaagagaaaagaaaactacttatgcagaaccagtcttcaacaaatcatcctggagctagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctc

SEQ ID NO: 6103 - DNA, 1653 bp, Homo sapiens
tttggaaaaaaaagtgacgtctgcactgaggtggccgctaaagtgcgaatcacgacgggcggtggccgttgggtcccggcgggaggcggggtttccgctccctggggcgcacgtcagtcaggaggcggaagcgcagcgggggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaaggttttcaaaacaaaaatagagttgcaatcttggcagaactggacaaagagaaaagaaaactacttatgcagaaccagtcttcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaa

SEQ ID NO: 6104 - DNA, 3091 bp, Homo sapiens
gactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcagagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 6105 - DNA, 1820 bp, Homo sapiens
cgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 6106 - DNA, 3133 bp, Homo sapiens
cctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagcagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcagagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 6107 - DNA, 1603 bp, Homo sapiens
cctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagaaggatgtcaggcttgcccaggaaaggggctgtgctgtcgtcctggtgtcagaagaagtgaggatgcctgcaggctgggactgctgctggggacgtttgggttggaaggaaggcggcagtcagacttgtcctgtgccggcactgctggggaggcccctccttcctgcagagccgtcccctcatcactgggttgattactccttagagagctccccactgctcagctgctccattccctaatggtttgccctccaaacccttccaaagcctcccagggagagaacgggaccctggacagagtcttgagctggaagcgtagggctgagctgtgtgtgactatccttttgctatggatgtgttcaagcagatctgatgtcctcgcctgtctcagcagcgggacccctgtttcctctttgtcttgcccctggattgcctggaagcaaatttcaggccttctttatgtcacctaaaaatatttcaaacacatctctaaaaaaatcagttgtttttttaacctgaccgtagtacctaatgtaataccgcatgttaaactcacagaaggtttttcttggagaaataagccacaataacaaattgaaaaaataaaattcccaaagagttct

SEQ ID NO: 6108 - DNA, 1841 bp, Homo sapiens
cctcccgtcccgccgagccggcgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagcagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctga

SEQ ID NO: 6109 - DNA, 3395 bp, Homo sapiens
ttttcactgcaaaaaaaaaaaaactagtgggttactagtgggaggcaaagatgagtttgagctgccacgtggtgacagctgacacttggactgctgtgcaggaacagccgtggagttgctgggcatctgctgctctctagggcctgggagggtggtgctgggctgacaggacacagagcccacagggccggcgcacagaagctctacctgccaccgcaccctcttcctggtttggggtgaggctgatggcagcgttcatgcccctctgctcaggcgacgtggatgtgattggtgtgggggcagatgcctggctgtgtgagggccccgggcgtgcctctcccctctggttctcccttccccttggaatccttgggtgggcgggaggctccatccatcagctcccccagtccccagcacgccccacaacagagcacagtcatgggagctcaggaggagtggttggcaccagcaggcccagctgcgatggtgcggtgtgaggcaggcctggggcctctcaggtggctccgaagggagggtccggcctccgccctcagtgattacttagattctgctccctcaaagtgaactagaggccagtcactggatgaagaaacagggtcagaaggtgacacaggcgggcccattcattcgcacctgtcagcagaagcgtactccatgggcaaaaacacagacatcgacccagccaggagggtccccttccaccacggatgacatcgtgaaggttgaagtctgggatgtagtagacaaaggggttttgtttgttgtcccagtccgtgactccaagactgggacccccagagttcccaggatggtctggagcctttatcctcaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcagagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 6110 - DNA, 887 bp, Homo sapiens
ggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagaaggatgtcaggcttgcccaggaaaggggctgtgctgtcgtcctggtgtcagaagaagtgaggatgcctgcaggctgggactgctgctggggacgtttgggttggaaggaaggcggcagtcagacttgtcctgtgccggcactgctggggaggcccctccttcctgcagagccgtcccctcatcactgggttgattactccttagagagctccccactgctcagctgctccattccctaatggtttgccctccaaacccttccaaagcctcccagggagagaacgggaccctggacagagtcttgagctggaagcgtagggctgagctgtgtgtgactatccttttgctatggatgtgttcaagcagatctgatgtcctcgcctgtctcagcagcgggacccctgtttcctctttgtcttgcccctggattgcctggaagcaaatttcagg

SEQ ID NO: 6111 - DNA, 2496 bp, Homo sapiens
actcccgggaaagacccggagacgggaccaccgcatgtggaaaccaccgggaagcacagcgcgtgggccgcctgagcggtgccggggcggggaggcagggccgccgctcaggccgtggacctcggggccgcgggacggacgtggatggcgccgccgttctctcgcgggcccagcgaggctatgcgtgcgcggcccgggcagtctctgcgagcccgggctgctgctcatctgggggggacggcggccgcccgactgagcccagagctgtgggccgcgcccgggttcctgcctcgggccggaggagggagggcgccgcggcccgtctcgggcctcccgccgcgctggggcctggctccctcctggctgcgctgagcgcctgcggctccgcttggggctgctgtgctctccacaggccgggccgccgggctggagggcgctgcaggcggcctctgttctccaagttctccgcgggagagggaggggaacgagggcccagccttccgcggggtgggctcggccgggagaagcgcggagcctcctggctgcccccagccggtgcggccgccaccgtggccgtgagggcgcctgggtcccctctggaggttttgccgcagcgctggccggcgccgagatatgaccagaggcgttgaaagttggcgcgttgaggtacctaggatgggcgaggaaatgaacaagcttcaggggagaagaaatgactgtgggaacagtgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcagagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagagg

SEQ ID NO: 6112 - DNA, 3328 bp, Homo sapiens
ctggatcacctgaggtcaggagttcgtgaggctccggcgtttgtatttcatttgaatctaaagtgagcagccacagggacccgcagctcatcagaccagcctggggttccaggccaggagggcagtggtttgctccagagccagctgcttgtgggtgtgggacggtggcgacgcgtgcaccggggatgtgtcctgccaccagaggaggtgtgcgtggcggggagcagaggggctttgtttcccaggtgaaggtgcggcttcttcactcttagaggtgcgtgtgtgggtgggggtgcttgctgttgaggtttatgcctgtgactgacagctgtcccccaagccatgctggcagtgtgtaggtgtcgtgccggccaccgcagaggaatcctctgggcttctgtggttcaagtggggcccagcgcagagctccatgagttgctgagcagccagccctgcagcatctcctggttttggcagcaggaggcgtcccctgtgcattcaggggctgtggggctggggcactcgcagcaggaaggagccctgctcaggcctgcgtgctccctttctgcagagggagacgctgttgcggcagctggagacgaaccagctggacatggacgccacgctggaggagctgtcggtgcagcaggagacggaggaccagaactacggcatgtatgtggccggacccgcccgtgcgggcggtgtgggggctgcgggcgtggccgtggtgcagggccatgggctgcaccaaggagacagcagaggggagtgtcccctgtttggggtaaattagtcacctttgggcacgggtggaggaggactcaggtttgcactgcccccagcagcccccccacagtcacccctggcgtggactcctcatacaggtcatgctgtgcctgccactctgagtaccgctgaccgtggccaggtgctggtgctcatggagtgctgctggggctgcctgcccatcaggggcttggcctcccagattgatgccagcatggggtgtgctttctggggagctgcttgactttgggaagctccctgtgttgaagaggcatacaggccaggacatggaggtctctggtcctcgatagcagagggcggctcagagcatcctcctgagtgggcctgggcagtgcatagccccggggttgcggccagtgggacagctggcccgttctctgcctcaggctcctgtacagctaggggcttggtgcctcccctgggacccaggcagggaccacggaatcagtggccctcctgaggccccccaggaggtctctgtttccagaaggagagccctgtgggtcaccttggatctggctgttggctcagacacagcaagagaccgagagggaaggcagtttgatgcctggagagggacccgtggcttccagctgccaggccagccccagaatggagccccccgcatgggcgcttctctgttgaaccaatcctggcatttcctgggcctgagagttgggtcagctggatgctgcgatggccgcacgtgctccaccaagccccagccccctcctcttcccagaaacccccgctcacgggaaggtccagttgctgccatctggccacctctgcatggagcccccaacagctgtgcctcagaacagatccgaagtgactttcaggggagctggacacatgtacgctggtgcctgctgtccccaccctttggcactgctgctctttctttttctgagatggagtctcgctctgtcgcccaggctggagcgcagtggtgtgatctcggctcaccgcaagctccgcctcccgggttcacgccattctcctgcctcagcctcccaagtagctggggctacaggcacccgccaccacacccggctaattttttttgtatttttagtagagacggggtttcactgcgttagccaggacggtctccacctcctgacctcgtgatctgcctgccttggcctcctacagtgctgggattacaggcatgagccaccgtgcctggctggcactgctgcccttggaagtggatggggatgatggcctctgtggggcgggtggcccagaacacagtggctcttcccagccccagcagcagcagcagagagccccctgtcacctgagggcctcagggagaggcaggggagccaggcttctcacccgccttctgcctttcagcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcagagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaag

SEQ ID NO: 6113 - DNA, 2547 bp, Homo sapiens
gaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagcagacctccaggttcctcctacttccgctatgctgagtcttccatgaagaacagcttcggcctaaagtaccttcataagttcttcaatatcccatttttgcagcttcaggtaagcactcaccacgtggggtggagtggctgctggtctctcacctccttccaggtgtctcctgtgtagcaacgggtctccctcctaacccctgagaaagctgtggacctgctcggagattggctgctggcaagggcccagcgttctactgcacctgcctgctctgggtggcagagggtacagggtcctgagggctagacccagtcccaggagcccctccacctctgcggggaccccttgctcagtttcccccagtgtttttggttgtttttgtttgttgagataaggtcttgctgtgtggcccaggctggagtgcagtggcgcaatcatggctcactgcggcctcaaactccggggctcaggcaatcctcccacctgtctcccaaagtgctgggatgccaggcgtgagtcaccgaggtactcgctgttcacatctcacatttccctggtgcttgtgtcaaaaccaaggaaccaactttggcctacggactaaactcactttcctttgtagaaacaagggccaggccagctgtggctgcaaagtagcccagcaaatgatgaggcttgaacctcctcgccctgggctgccctgattgggtctgggggacctgaacctcctcgccctgggctgccctgactgggtctgggggacctgaacctcctcgccctgggctgccccagctgggtctggggacctgaacctcctcgccctgggctgccccgcctgggtctggggacctgaacctcctcgccctgggctgccccgcctgggtctggggacctgaacctcctcgccctgggctgccccacctgggtctggggacctgaacctcctcgccctgggctgccccagctgggtctgggggacctgaacctcctcgccctgggctgccccagctgggtctgggggacctgaacctcctcgccctgggctgccccagctggatctgggggacctgaacctcctcgccctgggctgccccgcctgggtctgggggacctgaacctccttgcctgggctgccccgcctgggtctgggggacctgaacctcctcgccctgggctgccccagctgggtctgggggacctgtacctcctcgccctgggctgccccgcctgggtctgggggacctgaacctcctcgccctgggctgccccgactgggtctgggggacctgaatctcctcaccctgggctgccccagctgggtctggggacctgaacctcctcgccctgggctgccccagctgggtctgggggacctgaacctcctcgccctgggctgccccgactgggtctgggggacctggggcccagctgcagctgcagcagccttggtctttctccagaaggatgtcaggcttgcccaggaaaggggctgtgctgtcgtcctggtgtcagaagaagtgaggatgcctgcaggctgggactgctgctggggacgtttgggttggaaggaaggcggcagtcagacttgtcctgtgccggcactgctggggaggcccctccttcctgcagagccgtcccctcatcactgggttgattactccttagagagctccccactgctcagctgctccattccctaatggtttgccctccaaacccttccaaagcctcccagggagagaacgggaccctggacagagtcttgagctggaagcgtagggctgagctgtgtgtgactatccttttgctatggatgtgttcaagcagatctgatgtcctcgcctgtctcagcagcgggacccctgtttcctctttgtcttgcccctggattgcctggaagcaaatttcaggccttctttatgtcacctaaaaatatttcaaacacatctctaaaaaaatcagttgtttttttaacctgaccgtagtacctaatgtaataccgcatgttaaactcacagaaggtttttcttggagaaataagccacaataacaaattgaaaaaataaaattcccaaagagtt

SEQ ID NO: 6114 - DNA, 2441 bp, Homo sapiens
gtgattccacttcagtgttcatttttatttttctgaaagtaaagatactcctgtaaaatgccattgtccatagaaaaaatattaactcattaagtttaaagacagatgataccttaatattaacttacttacacgattttaaagacgcctactgagagaactcaaatttataaactctgttgcctaataattatggtttaattctatatcctcttgcttgttacagttatacttaatttgcagtagatttttaaatgaaattatttgaatgtattccagactattttatttaaaatcatcatacatcatatactttgaacctttattttctaatgcaatcataaacattttaagttttattaactcactagcatccccactgactatattctgttttgctttatctgctcaagcactttcgaccatattttattttaggatttttatttttatcttccacagctggatattgctatttcacttttatttcacatgcagctttaagacgtatgagcatcagcacagcaaaatggttccagcctacagaatgcagtctcccagggccctgccaagaacatatctgtatgtctggccctacaaatgacaaatggtaattcccttctattttagctcttaattagttgctttcactatttccgaatatacctgtggctaagtttttattgaaacactcaaaaataccacttctcagtatgaacacaattgctaagagcctaatttggttctggactatggtcaacctgtgtgccttgttagttctctccagcagctggtgagtaaggaaatgacccttcaatttcctcttctttttcctctgacctctgtgacttaatttttcttaatgtctccaagtcatcaagggcttaataatttatgaattttacaaaaagcatttaaggaataagaaagaggttctgtgatttttcagactctgaaaattcattttgattctacatattccagaaatatactgggttggatgctagagtgaagaaagccgtccagacaattctcccagtccattcatttcttcattcatttgttcattcagtagttattgagtgcttatttcctgggtgcctggctctaggctatgtcctgagacatacagtggacagggtctctaccctcctcacaacaccctcttcaccctccacgccaccccctactactcactctcaccctagcaaggagcttcgtgctaataagagagagtcttacctgaatggcaatcgcccagattaacagtggagacagtaatgcaatgcaggaagttaagtttttaaaggtgattctgtgcagtaaggtataaaacagatatataataaatagcctagcttagtctaacatctctttagaattacacagctaaaaaggaaaaaaaacaccaaaataagataaaataaaacaaatttaaacaccaaaataagatataataaaacatttgtttttgcaaaataaggcccaatgttatggcctaatgaaagctatatacttgtgctatctaaagcactactttgtaaagatgactacccaagattgtaaatacaaaatttaaaaaggtacttaaattttctggaatatccatgtttcagaggtaatatttactttctatttcagtggcttaaattataacgttttggcttaagtgtcttttatcaatacaatgataagacaccttaatcctgagagagaaaattaagtactgtatataggtgtactttgcttctcacaatgattgtgcaaaaagtcacgtgtaaattgaacttttgtaaatcaaattgtattttaaatgcattaggggagctgccatttagaggaaacttgtgaattctttcataaagcagaaaaccattttataatacaaataaccattctctgatttatctcttttgtatgtttggattttcaatatcgactttgcttaaaacagagcccacctgcatagtaactgtgttttgccaaggctgcttgtgctaccagtttgctggtggctaacggcttgtgcttgaaagtcttctgaagtctgatgtgaattgagctatcaagcaatgctatcatagcacagtagcagtcctgaacagtctgagcagccaacccatttcaacaaaattgaacacaggactcttctgctcagcagcatctcttttctcagatgtggccatgttacagtagagggtattccataagcacatattccataaagtgctcagagtcacaggttttataataaattatgttattatgtaaacgaattgcatgcatgttgaaattttttagcagtactttagcttgaaagtactcgtacaaatactgttagatttagttgcaaataattgttctcaagttattgcaataaatgtcaaatgaaacaagctcttgtgtaaatagacttctgtgcctaatagtgacattgtttc

SEQ ID NO: 6115 - DNA, 548 bp, Homo sapiens
ataaagcgggacaacacagaacttcccagttacaccaggcatcctggcccaaagtttcccaaatccaggcggctagaggcccactgcttcccaactaccagctgagggggtccgtcccgagaagggagaagaggccgaagaggaaacatgaacttctatttactcctagcgagcagcattctgtgtgccttgattgtcttctggaaatatcgccgctttcagagaaacactggcgaaatgtcatcaaattcaactgctcttgcactagtgagaccctcttcttctgggttaattaacagcaatacagacaacaatcttgcagtctacgacctctctcgggatattttaaataatttcccacactcaatagccaggcagaagcgaatattggtaaacctcagtatggtggaaaacaagctggttgaactggaacatactctacttagcaagggtttcagaggtgcatcacctcaccggaaatccacctaaaagcgtacaggatgtaatgccagtggtggaaatcattaaagacactttgagtagattca

SEQ ID NO: 6116 - DNA, 633 bp, Homo sapiens
agcatttgctcaggcagcctctctgggaagatgctgcttcttcctctccccctgctgctctttctcttgtgctccagagctgaagctggtctataacagtcacccttggagcccataacataacagaggaagaagacacatggcagaagcttgaggttataaagcaattccgtcatccaaaatataacacttctactcttcaccacgatatcatgttactaaagttgaaggagaaagccagcctgaccctggctgtggggacactccccttcccatcccaattcaactttgtcccacctgggagaatgtgccgggtggctggctggggaagaacaggtgtgttgaagccgggctcagacactctgcaagaggtgaagctgagactcatggatccccaggcctgcagccacttcagagactttgaccacaatcttcagctgtgtgtgggcaatcccaggaagacaaaatctgcatttaagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaatcctggatcc

SEQ ID NO: 6117 - DNA, 937 bp, Homo sapiens
agcatttgctcaggcagcctctctgggaagatgctgcttcttcctctccccctgctgctctttctcttgtgctccagagctgaagctggggagatcatcgggggcacagaatgcaagccacattcccgcccctacatggcctacctggaaattgtaacttccaacggtccctcaaaattttgtggtggtttccttataagacggaactttgtgctgacggctgctcattgtgcaggaaggtctataacagtcacccttggagcccataacataacagaggaagaagacacatggcagaagcttgaggttataaagcaattccgtcatccaaaatataacacttctactcttcaccacgatatcatgttactaaagttgaaggagaaagccagcctgaccctggctgtggggacactccccttcccatcccaattcaactttgtcccacctgggagaatgtgccgggtggctggctggggaagaacaggtgtgttgaagccgggctcagacactctgcaagaggtgaagctgagactcatggatccccaggcctgcagccacttcagagactttgaccacaatcttcagctgtgtgtgggcaatcccaggaagacaaaatctgcatttaagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaatcctggatcctgagccagcctgaaagggaagctggaactggacctgagcagcaaagtgtgtgccactcattctggtctacccttggtccctcagccacaaccctaagcctccagaagtatcctacaggtcacagaactctcaataaacctcagtgaagacaca

SEQ ID NO: 6118 - DNA, 3147 bp, Homo sapiens
cagccagtcctgagcacctaaccatgttgggcatcactgtcctcgctgcgctcttggcctgtgcaacacccggacctaccgtgtggccgtgggaaagaacaacctggaggtggaagacgaagaaggatccctgtttgtgggtgtggacaccatccacgtccacaagagatggaatgccctcctgttgcgcaatgatattgccctcatcaagcttgcagagcatgtggagctgagtgacaccatccaggtggcctgcctgccagagaaggactccctgctccccaaggactacccctgctatgtcaccggctggggccgcctctggaggggactccggtggcccactgaactgccagttggagaacggttcctgggaggtgtttggcatcgtcagctttggctcccggcggggctgcaacacccgcaagaagccggtagtctacacccgggtgtccgcctacatcgactggatcaacgagaaaatgcagctgtgatttgttgctgggagcggcggcagcgagtccctgcaacagcaataaacttccttctcctcgggccacctggatccttgatttgtgcagcttctgttgcttccctcctctctggtgctgcccctttccacactatggagccaaagagagaccccactcagccagtttcccccaccctgcattagacaggtggggaaacagaggccgggagagagggccaaggaaggagcctcctggggcattaatgggaggcagggggctggggtggagagcccagggagtcctgcgtgaagccggaggggatgggagtgaaggacgcatcagacaccttccccgctccatctcacaagctgcgaacaggtgagaccctgatgaaatcactcgcttctccgatcctacctccaccgaggggcctggcaggtcctcacagccccccagcagcaggtggaagacagggtctccccaaaagcagcgtcccccaggccagagagaccaggccacaggaggatggccaaagctcagggacaaccactcctggggaaggggctccctagcagggaccccccacccccaccccgcagcacagaccccatggctgctgttggcaggggctctctgctttgagaagtgtttagtgagccagcccctgtgtccagtcctgtgctgggcatgatgagggtacaggaagaggaagagaccccagcatcatcctcaggagacatacgtttgaagaaggcaatggtttccacacagaatcacagtggtcagagctggatatgctttcattgcattagacaagtggggaaactgaggcccagagagaggaaggagttgggatagctggcaatgcctgatccaggagaagagagttctcctgaggctgacaagaggccaagaggagccagagatgagatagacccagtgtccagggagggacatgccagtgggatcagaccctgatgacaggggcagccagagatgagagagatccaatgtccagggagggacatgccagggggatcagaccctgatgataggggcctctggcctggcctgctcctgggaatgtcctgttctgtgggggtgcccccagcccagcctctggacccctcgctggagagccctcggctgcagctacctcagactggcccaagagttgtcccttttctccaccagactttgtcccctgggagtggggaccatggtgtgactcccacacccccatgatgccaaggcaagtctcaggaaagacttgacttactcaacaagcagtgggagctacagggagcccagcaccacccagacccgggaatccaggatgggggtaccccagctgtgcaggagacagaccagtaaatagatcattaaattccctggtatacatttgaaaacagaaatacagaccagaagcatagaaacaggacacctgaagcagtgtcagttggcgggaggaatccaggatggcttcctggaggtgatgatgcccaagcttggtcttaaaatttgactagaaggtacccaagtacagaacgtagtccttcttaagtttgcttaatctaaacttcattcccacctatcctcttcttttttttttttttttttttgagacggagtcttgctctgatgcccaggctggagtgcagtggcacaatctcagctcactgcaacctccacctcccaggttcaagtgattcttctgcctcagcctcccaagtagctgggattacaggcacgcaccaccatgcacagctaattttttttttttttttttagacagagtctcgctctctcacctgggctgtagtgcagtggtgccatctcggctcactgcaagctccgcctcccaggttcacgccattctcctgcctcagcctcctgagtagctgggactacaggcgccagccaccatgcctggctaattttttttttttttgtatttttagcagagacggggtttcaccgtgttagccaggatggtctcgatctcctgatctcgtgatccacctgcctcggcctcccaaagtgctggcattacaggcgtgagccaccgtgcccggccccagctaatttttttgtatttttttagtagagatggggtttcaccatgtcgtccaggctggtctcaaactcctgacctcaggtgatctgcccgccttggcctcccaaagtactgggatcacaggtgtgagccaccacacccggtctcattcccagctatcttcttttgtgtatgtctttatattgggggttataaatgctaaatgcttgctgtcctcagatcccttgtagttagggagctaattaaaatgttaattaatattacaatgttatttaagcaatgttaaataatatctaacatttattgggcacttagtatgtgccaagcactatcctataggttttacattatctcaatccccagaaacaatcccatgaggtaggttactattaacatcatgcccattttacagatgagaaaactgaggccagacagggttagtgacttcccaatgtgtgaactagaaggtagtggagccggaatccagactttagtgatctgactccagggcctgtgctcttgtccaccatgctctgctgccctgcaatgtaaaacatcctccagaaaaaaaataaataaataaaaacttccctgatg

SEQ ID NO: 6119 - DNA, 898 bp, Homo sapiens
ggtcagccagtcctgagcacctaaccatgttgggcatcactgtcctcgctgcgctcttggcctgtgcctccagctgtggggtgcccagcttcccgcccaacctatccgcccgagtggtgggaggagaggatgcccggccccacagctggccctggcagatctccctccagtacctcaagaacgacacgtggaggcatacgtgtggcgggactttgattgctagcaacttcgtcctcactgccgcccactgcatcagcaacacccggacctaccgtgtggccgtgggaaagaacaacctggaggtggaagacgaagaaggatccctgtttgtgggtgtggacaccatccacgtccacaagagatggaatgccctcctgttgcgcaatgatattgccctcatcaagcttgcagagcatgtggagctgagtgacaccatccaggtggcctgcctgccagagaaggactccctgctccccaaggactacccctgctatgtcaccggctggggccgcctctggaccaacggccccattgctgataagctgcagcagggcctgcagcccgtggtggatcacgccacgtgctccaggattgactggtggggcttcagggtgaagaaaaccatggtgtgcgctgggggcgatggcgtcatctcagcctgcaatggggactccggtggcccactgaactgccagttggagaacggttcctgggaggtgtttggcatcgtcagctttggctcccggcggggctgcaacacccgcaagaagccggtagtctacacccgggtgtccgcctacatcgactggatcaacgagaaaatgcagctgtgatttgttgctgggagcggcggcagcgagtccctgcaacagcaataaacttccttctcctcgggcca

SEQ ID NO: 6120 - DNA, 1174 bp, Homo sapiens
ctcacatctgccacgatgttgctgctcagcctgaccctaagcctggttctcctcggctcctcctggggctgcggcattcctgccatcaaaccggcactgagcttcagccagaggattgtcaacggggagaatgcagtgttgggctcctggccctggcaggtgtccctgcaggacagcagcggcttccacttctgcggtggttctctcatcagccagtcctgggtggtcactgctgcccactgcaatgtcagccctggccgccattttgttgtcctgggcgagtatgaccgatcatcaaacgcagagcccttgcaggttctgtccgtctctcgggccattacacaccctagctggaactctaccaccatgaacaatgacgtgacgctgctgaagctcgcctcgccagcccagtacacaacacgcatctcgccagtttgcctggcatcctcaaacgaggctctgactgaaggcctcacgtgtgtcaccaccggctggggtcgcctcagtggcgtgggcaatgtgacaccagcacatctgcagcaggtggctttgcccctggtcactgtgaatcagtgccggcagtactggggctcaagtatcactgactccatgatctgtgcaggtggcgcaggtgcctcctcgtgccagggtgactccggaggccctcttgtctgccagaagggaaacacatgggtgcttattggtattgtctcctggggcaccaaaaactgcaatgtgcgcgcacctgctgtgtatactcgagttagcaagttcagcacctggatcaaccaggtcatagcctacaactgagctcaccacaggccctccccagctcaacccattaaagacccaggccctgtcccatcatgcattcatgtctgtcttcctggctcaggagaaagaagaggctgttgagggtccgactccctacttggacttctggcacagaaggggctgagtgactccttgagtagcagtggctcttcctagagtagccatgccgaggccggggcccccacccctcctccagggcaaccccttggtcctacagcaagaagccagaactgttggaatgaatggcagccctccctggagaggcagcctgtttactgaatacagaggatacgtttacaaactgaatacgcataataaataactgcacattctccatcca

SEQ ID NO: 6121 - DNA, 1721 bp, Homo sapiens
cacgtgctggtgggagagtcaccatctctgagcagacctgtgactcctgttccaaatggacgaggaaccactgcgatgatgtgttaggactcccagcctgccagaacctcacagcccctggcccttcacagcaaagttgaccgcagtgagcattccatccaccagtcagaacaccctggacgctgagcggccttctctgaaagcctggtgcctttgttagccctgggtgactcctgtgatcccagccaccaggttgtcactatagacctaatttaaccatctgtcctcagtaccgagggctcaacatttggaatgggaggtggttctgggagccaattagaggccaggctttgggaggtggcagaggtgagtctcacacctgggctctgtctgataagtctaggtctcggtcaggggaccttggcctaaagggcctgtcttgcctggagcgtgggagggggctgagtctacacagctggcctggcctcaggcctggagctttagctcaaggacgagaagacccataaagccagacccagctcccaacctcacatctgccacgatgttgctgctcagcctgaccctaagcctggttctcctcggctcctcctggggctgcggcattcctgccatcaaaccggcactgagcttcagccagaggattgtcaacggggagaatgcagtgttgggctcctggccctggcaggtgtccctgcaggacagcagcggcttccacttctgcggtggttctctcatcagccagtcctgggtggtcactgctgcccactgcaatgtcagccctggccgccattttgttgtcctgggcgagtatgaccgatcatcaaacgcagagcccttgcaggttctgtccgtctctcgggccattacacaccctagctggaactctaccaccatgaacaatgacgtgacgctgctgaagctcgcctcgccagcccagtacacaacacgcatctcgccagtttgcctggcatcctcaaacgaggctctgactgaaggcctcacgtgtgtcaccaccggctggggtcgcctcagtggcgtgggcaatgtgacaccagcacatctgcagcaggtggctttgcccctggtcactgtgaatcagtgccggcagtactggggctcaagtatcactgactccatgatctgtgcaggtggcgcaggtgcctcctcgtgccagggtgactccggaggccctcttgtctgccagaagggaaacacatgggtgcttattggtattgtctcctggggcaccaaaaactgcaatgtgcgcgcacctgctgtgtatactcgagttagcaagttcagcacctggatcaaccaggtcatagcctacaactgagctcaccacaggccctccccagctcaacccattaaagacccaggccctgtcccatcatgcattcatgtctgtcttcctggctcaggagaaagaagaggctgttgagggtccgactccctacttggacttctggcacagaaggggctgagtgactccttgagtagcagtggctcttcctagagtagccatgccgaggccggggcccccacccctcctccagggcaaccccttggtcctacagcaagaagccagaactgttggaatgaatggcagccctccctggagaggcagcctgtttactgaatacagaggatacgtttacaaactgaatacgcataataaataactgcacattctccatcca

SEQ ID NO: 6122 - DNA, 868 bp, Homo sapiens
accttctgaggcagcggcatggcttccctctggctcctctcctgcttctcccttgtgggggccgcctttggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggcgactctggcggccccctggtctgccaaaaggatggagcctggaccctggtgggcattgtgtcctggggcagcgacacctgctccacctccagccctggcgtgtacgcccgtgtcaccaagctcataccttgggtgcagaagatcctggctgccaactgagcccgcggctccctccgaccctgctccccacagagcctcagtaaacccatggaacaca

SEQ ID NO: 6123 - DNA, 1910 bp, Homo sapiens
gcggcggcagcggaggcggcggctccagccggcgcggcgcgaggctcggcggtgggatccggcgggcggtgctagctccgcgctccctgcctcgctcgctgccgggggcggtcggaaggcgcggcgcgaagcccgggtggcccgagggcgcgatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacgctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatgag

SEQ ID NO: 6124 - DNA, 2052 bp, Homo sapiens
ctgaagagccggtgcagagcgggcggcggcggcggcggcagcggaggcggcggctccagccggcgcggcgcgaggctcggcggtgggatccggcgggcggtgctagctccgcgctccctgcctcgctcgctgccgggggcggtcggaaggcgcggcgcgaagcccgggtggcccgagggcgcgactctagccttgtcacctcatcttgcccccttggttttggaagtcctgaagagttggtctggaggaggaggaggacattgatgtgcttggtgtgtggccagtggtgaagagatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacgctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatgag

SEQ ID NO: 6125 - DNA, 921 bp, Homo sapiens
gcacggggaccacagccgtcttgagggcgcgcccgagaaaggactctagccttgtcacctcatcttgcccccttggttttggaagtcctgaagagttggtctggaggaggaggaggacattgatgtgcttggtgtgtggccagtggtgaagagatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcat

SEQ ID NO: 6126 - DNA, 7224 bp, Homo sapiens
gcactccggccgggctctgctggctgcggcgggagctggacgcgggaggaggcggcggcggcgctggaacagtgaaccatggagctgtatttcggtgaatatcaacatgtgcagcaggaatatggggtccatctgagactcgcaagtgatgatacccaaaaatcaaggagttcccagaactccaaggcaggctcctacggtgtcagtattcgggtccagggaattgatggtcacccctatattgtcctgaataacacagaacggtgcctagcaggcacatcgttttctgaaaatgggccaccctttccacctccagtgataaataacctgcctctacattccagcaatggttctgtgccaaaggagaacagtgaagaacttcagcttccagaaaacccatacgcccagcctagcccaataagaaacctgaaacagcccctgctccatgagggcaagaatggagttctagatcgcaaagacgggtctgtgaagccatctcacctgctgaactttcagaggcatccagagcttttgcaaccctatgaccctgaaaagaatgagttgaatttacaaaatcaccagccttctgagagtaattggctaaaaacgttgacagaagaaggcatcaacaataagaagccttggacttgctttcccaaacctagcaattcccagcctaccagtccctccttggaagacccggccaaatctggtgtgacagctattcgtttatgcagctccgtggtcatagaggaccccaaaaagcagacctcagtgtgtgtaaacgttcagagctgcaccaaggagagggtgggagaggaggcccttttcactagcgggaggcccctgactgcccacagcccacatgcccaccctgaaaccaagaaaaccaggccagatgttcttcccttccggcgacaggattcagcgggacccgtcctggatggagctcggtcccggaggtcctcctcgtcatccacaactcccacgtcagccaactctttgtacaggtttttactggatgatcaggaatgtgccatccatgccgacaacgtcaatcgtcatgaaaacagaaggtatattcccttcctgccaggaactggacgggatattgatacaggatcaattcctggtgtggatcagttaattgaaaaatttgatcaaaaacctgggcttcagagaagaggaaggtctgggaagcgaaacagaattaatacagatgacaggaaaagatccagaagcgtggatagcgcctttccttttggcctccaagggaactcggagtacctgattgaattcagtaggaacttgggcaagtcaagcgaacacctcctccggccttcccaggtgtgcccgcagcggccactgtctcaggagcgccgtgggaaacagagcgtgggccgcacctttgcaaagctgcagggagcagcgcacggggcttcatgtgcccactccaggcctccccagccgaacatagatgggaaagttctggaaaccgaaggtagtcaggaaagtacagtgatccgtgcgccctcccttggtgcacagagtaaaaaggaggaggaggtgaaaacagccaccgctacgctgatgttacagaaccgggcaacagcaacttcgcctgattctggtgccaagaaaatttccgtgaagacatttccttcggcctcaaatactcaggccacaccggatctcttaaagggccagcaagagctcactcagcaaaccaatgaggagacagctaagcagattctctacaattacctcaaagaaggaagcactgataatgacgatgctactaaaaggaaagtcaacttggtctttgagaaaatccagaccttaaagtctcgagcagctgggagcgcccaaggaaataaccaagcttgtaattccacatctgaagtcaaagatctattggaacagaaaagcaagttgaccatagaagtggctgaacttcagagacagcttcaactggaagtcaagaatcaacagaacattaaagaagagagagagaggatgagagcaaacctagaagagctccgaagccaacacaacgaaaaggtggaggagaactccacattgcagcaacgactggaagaaagtgaaggggagctccggaagaatctggaggagctattccaggtgaagatggaacgggagcagcatcagactgagatcagggatctccaggaccagctctcagaaatgcacgatgaactggacagtgcaaagcgatcggaggacagggagaagggagctctgattgaggagctcttacaggcaaaacaggatcttcaagatctgctgattgccaaagaggagcaagaagacctcttgagaaagcgagagcgtgaactcaccgccctgaagggagccctgaaagaagaggtttccagccatgatcaggagatggacaagctgaaggagcaatatgatgctgagttgcaggccctgagggagagtgtggaagaagcaaccaagaatgtcgaggtcttggcgagcaggagcaacacttcagagcaagaccaggcggggactgaaatgcgcgtgaagcttctgcaggaggagaatgagaagctgcagggaagaagcgaagagctggagcggagagttgctcagcttcaaaggcagatcgaggacctgaaaggcgatgaagccaaggcgaaggaaacgctgaagaagtacgagggagaaatacgacagttagaggaggcccttgtgcacgccagaaaggaagaaaaagaagctgtgtcagccagaagggccctggagaatgaactggaggctgctcagggaaatctgagtcagactacccaggagcagaagcagttgtctgagaagctcaaagaggagagtgagcagaaggagcagctaagaaggttgaagaacgagatggagaatgagcggtggcacctgggcaaaaccattgagaaactgcagaaggagatggcagacattgttgaggcctcccgtacctcaaccctggagctccagaaccagctggatgagtataaggagaaaaaccgcagggagctcgcagaaatgcaaagacagttgaaggagaaaacgctggaggcagaaaagtcccgactgacagccatgaaaatgcaggatgagatgcgtctgatggaggaagagttacgggactaccagagagctcaggatgaagcactcacaaaaaggcagcttctggagcagacgctgaaggacctggagtatgagctggaagccaagagtcacctcaaagatgaccgcagcaggctggtcaagcagatggaggacaaggtgtctcaactggagatggaactggaagaagagagaaacaactcagatttgctgtctgagaggatcagtaggagcagggaacagatggagcagttgaggaatgagctacttcaggagagagctgcgagacaagacttggagtgcgacaagatttccctggagaggcagaacaaggacttaaagagccggattatccacctggaaggttcctacaggtccagcaaagaggggctggttgtgcagatggaggccaggatcgcggagctggaggaccgcctggagagtgaggagagggatcgggccaatcttcagctcagcaaccggcggctggagcggaaagtgaaggagctggtgatgcaggtggatgatgagcacctgtcattgactgatcagaaggaccagctgagcttgcgtttgaaagccatgaagcggcaggtggaggaggctgaggaggaaatcgacagactggaaagttctaaaaagaagctgcagagggagctggaggagcagatggacatgaatgagcatctgcaggggcagctcaactccatgaagaaggacttaagactgaagaagctgccgagtaaagtgctggatgacatggatgacgacgatgacctcagcacggatgggggaagcctctatgaggcgcctgtgagctacacattctccaaggacagcaccgtcgccagccagatctgagtgctctcccgggctgtggaagtacctgtcattcctgcaggagctgcagccacccaaagtgggaggcagggaggggagcatctgtctgccactgagaccaatcacagcctctttgcacagcatgccagctcctcagtgttacattcctcgccagggtctctcagtgggtcttcgacagagagcttttgcagtttaaaatgttgggatgcctgaggaccaggagccaccacccactggggtgttgtgagagatacactttggtaggctgaggcccctgttccacagccactatttgcattgctgtccctgccccctcatcactccccctgccaagacaaagggtccagaaggctaggacttacttaatagcactgtgcagggaggaaaccatgtatagcttgtacatattttaaaccagaccttctcacgaactgctgctgttgggtttggaatgtgatggaggcttggtagggtggctggtttgtaaagttcatgcatctatattgagtattctttttttttttttttgagatggagtttcattcttgttgccgaggctggagtgcaatggcgcaaccttggctcactgcaacctctgcctccctggttcaagtgattctcctgcctcatcctcccaagaagctgagattacagatgaccaccaccactcctggctaattttttgtatttagtagagacggggtttcaccatgttggtcaggctggtcttgaactcctgacctcaggtgatccacctgcctcagcctcccaaagtgctgagattacaggcatgagccaccacgcccagccattgagtattcttttttaaaatatgaagctattagattttaagtgttgaggagcagaggtgagaagagagagagagagagaaagtcaaataaagtcaaagaccagtttggaaaccaaagttggaaaagaagaattgtagtggtcatggacagctaagactgagcatagcagttcacatggtctgggtaaacaagtcactggcacaggggaaagccagaaggttgcttgtgtctgtgactgcagctatggccttgtttgcttagtttatctggaattctgttataatttctgaactgttctgagacctgttcccagtcactgattgcaatttcttttacacaggttgggtagggagagttgtaggtaaggccttaaacaaatgaggccgtttctggaaggatagggctgtgtggtcatgtcccacagcaagcttttgggatcgggggaataagagggtatgggggaaaggttcatagacttaggtgtgagaatgaggtgggaggtgtctggtaaggtcatgggggaagggagatgagagaggagataggcagatgtgggtatggggcccagtgtgagaaggaagacagagaagttcttgaaagctgggggatgtgtgggcaagaggtggattgagcaggatctcagggttatgtcgaggaagggaagaaagaaacagaagtcaggcagaggcgtgtctgtgcaaactggaggactccttccaacttcctggaacaaagcgacatcgccagcagcaggctggcagggagtggttgaggtctgggggccaggccacatggctggagaggaatttcagggagcatagcatcgggaggatgctacatatccagggactccctcctggccttcctgtgtcacttcacaatgtgacagtccccaggcatgcccacaggccaggcccagtcacagctgggcttccacaggtcagaatatgggacaggacatggtcagggagaggaccctgtgagttggtgacatatatgtggcagagatggtagtgttcagctgcttcagcagtgtccccaaccatcccaatagggtgggggcctgtgggccagaggactccatgacagtagccatggagtcccacctgtgccaggtcagagcccacccggcaggtttcagagtggtcagcccagtttaagggtgggagtctggagccagacagccaagccccttccacatctacagggtcactgtcatcctcaccacagccaggggtgattctcacctctgcctgcttatgtggggtgtggccgattcctccctttagtcattcattcatttagcacatatttattgggcatcggtgatgtgtcaggcacagtccttggcacacagaatacagcagtgaattaaacaggcaaaaattcctcccctcctggagctcagtgtcaggaaagggggtgataaatgacaatcaaatcgacatggaggttgagcacctctgtactcagccctctgtctgtccttctgaggacgcaacaagcctggttccctagagctcactttgaccctcaatatgttcataatttccctgctgcttctcccatcgttagacatctgccagtaagcctgctgagagaagcctcagcccactcatacctagagacgctgctggggaaggtcagcacacccaagaactttgggagtgtgtgtctgttttggtttgtgagaaagtagctgcccctcattctggccagttctttccagtagccatggggctggctacaagaagcaaaactgcccatgcaaagagaacacaggtcacttttcaaaacacttgcatcattaccctaaaaataggctgttatgcgttttgacaattgcgctatcctacactctgagggagttggcaacgcatgcggtatagtggagtgggaagagttgagactgaaagttaagagaagggttttcaagtcccggctcatctcaccccagtgactttgacagtgtgctcactctcagagccatggattacctggaacaaagtgcagattagtgcccacggtcctttccaggtataacatgctatcgttctttaattttattatatatacatacttttcttctgttttttgctttaagaactaaccccgatcaagagtattttctttagctagcttaaaaagaaaacatatattttatgtaaaaacacatacatggccaaatgcaatactgaagagacaatcatcctgtatcttttatggtttttcctgcttctgagtgtcgttctacaatgcccgttgacttattccattgcgtctctgctttagggtatggtttggtcgctttggttgtcatgagaaagagacattctccttgcagctacctccatgtgagtgaattcctggataaagcaagatttcctttcaataaacgctgtcacccaatgggaattttgactct

SEQ ID NO: 6127 - DNA, 2322 bp, Homo sapiens
gcggccaacgggcgacaaccgaacctcccgccgccgtcgccgccgccgcgagcactgcctgcgcacttccgactatgcgccaggagcacttccggggcagagcctgagagcgcgcgcgcacgtggggccggggcggagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggcaagaatggggatactcttccactctctaaaaatgcagatcatttactgcacctaaagacaaagggtcctgagaacattatctgtagctgtatctccccatgtggaagttggatagcctattctacagtttctcggttttttctctatcggctgaattatgaacatgacaacataagcctcaaaagggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttga

SEQ ID NO: 6128 - DNA, 1861 bp, Homo sapiens
gcgcacgtggggccggggcggagagaggcgagcaccgggaaggggagcgtggggccgctggaatgggtgaatttaaggtccatcgagtacgtttctttaattatgttccatcaggaatccgctgtgtggcttacaataaccagtcaaacagattggctgtttcacgaacagatggcactgtggaaatttataacttgtcagcaaactactttcaggagaaatttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttggttgtgaagatggatctgtgaaactatttcaaattaccccagacaaaatccagtttgaaagaaattttgatcggcagaaaagtcgcatcctgagtctcagctggcatccctctggtacccacattgcagctggttccatagactacattagtgtgtttgatgtcaaatcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgaccaagaagacagtttcgtggtgggcacagccgagggaacagtcttccattttcagctggtccctgtgacatctaacagcagtgagaagcagtgggtgcggacaaaaccgttccagcatcacactcatgacgtgcgcactgtggcccacagcccaacagcgctgatatctggaggcactgacacccacttagtctttcgtcctctcatggagaaggtggaagtaaagaattacgatgccgctctccgaaaaatcacctttccccaccgatgtctcatctcctgttctaaaaagaggcagcttctcctcttccagtttgctcatcacttagaactttggcgactgggatccacagttgcaacaggaacagtggaggccatgtgtcttttggcagtcagtccagatgggaattggctagctgcatcaggtaccagtgctggagtccatgtctacaacgtaaaacagctaaagcttcactgcacggtgcctgcttacaatttcccagtgactgctatggctattgcccccaataccaacaaccttgtcatcgctcattcggaccagcaggtatttgagtacagcatcccagacaaacagtatacagattggagccggactgtccagaagcagggctttcaccacctttggctccaaagggatactcctatcacacacatcagttttcatcccaagagaccgatgcacatccttctccatgatgcctacatgttctgcatcattgacaagtcattgccccttccaaatgacaaaaccttactctacaatccatttcctcccacgaatgaatcagatgtcatccggaggcgcacagctcatgcttttaaaatttctaagatatataagcctctactcttcatggatcttttggatgaaagaacactcgtggcagtagaacggcctctggatgacatcattgctcagctcccaccacccattaaaaagaagaaatttggaacctaaaacagggcactgtctgtgtccttccttgaactgtctaccctgttgcttttcacaaatcatggtaataaaacaagttattcttg

SEQ ID NO: 6129 - DNA, 1169 bp, Homo sapiens
atggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccatagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggctaaagggtattgaagctgcagagggatcaacttgtgcttgccagaggacgccaatgaagtttgaaacaccaacaatcagagattttgtttctgttcctcattaaatcatgagcttttgtg

SEQ ID NO: 6130 - DNA, 1127 bp, Homo sapiens
gggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtgggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccatagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggtgggctgaacatatacagtggggttcttaaagacaaaccacaatactcaaagcaacttgttaggatgccagattgggacctgactccatttacagttcatgttaatcacaattttgttgttgttgtctcactggccagttattcccctaaaaaaatgaacgcttttccctttgga

SEQ ID NO: 6131 - DNA, 5667 bp, Homo sapiens
aggcaaagggcggggcgcgcgcgtcgggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtgggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccatagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggctaaagggtattgaagctgcagagggatcaacttgtgcttgccagaggacgccaatgaagtttgaaacaccaacaatcagagattttgtttctgttcctcattaaatcatgagcttttgtgccgagactctggacgactgttccttaagaaattaacagaatgggaagttttaaactctacaccaaccttttcatgacctacacagcagcaacgctgctactcttagacaaacaccgcggggaaggctgttctgtttatttaaatttgtaaatagaaaacagttgttttttactttcatttttcacctcctcctacgcccttttggattatttcctctgcggcccctagcatgagccccaaccaggcctccccttttccccacttctctcaattcccacaggaagcccgagaggtgaggagctgaggttagacaccaggagaggcaccatcacacaaaagcgcggccgcagagtcccaccgccaccaggcgacccccacccagagagggacagacatgcggggagccagcaccgggcaagatggctctggggatcctcattctgtgaagacaccaactcatttctcaaacacaggatccaggagacagatagctcctaaatggagatggcacatgctccgtggggtccctcatagaggagtgccaccctccacactggccacgctgggctgccccagagcggccagaaaggaaggtgggagctagccccatcctcactcagaggccggaaggaggaagatggcatctcgccaacttcagagccgaatggcctctagccacactgcttccagaccccagacggggcagcagcagcagttcccagaggagcacccattgttgcagctaggacccaccaaggatgggactcctggagtcaggtgcacaccaggtaacccaggaccacgctgtgcacccccagtctgcccctctgctcagaacacagagggatgggaggatggcttggcagtgggaaggcaaaagaaggcctctctcactctgcccctgccatacgcacccgctgagggtgttagaagcagtggaggcagagctggccctaagcaaaagaagaaaataaacctcaccttgtccttcctatgggcagccctcaccccaatctaactaaccttcccatcctccagcctaatccaaagaagcccttggcttgaggggatgaagggcttgcgttctagtctccaccccagccccacaggcagccagccagccagccccacacagaggggcctcctcaaggcctcactgggagcctcctgtccccagccaaggagccctacagacctggggaaaagcaggcccctccgcaaggcccctgggtggtgcggaggccggaccggctaggcctcccgctgctggccactcccaggccacgggttcctaggtcccaaccacattggactgctcgccacgccactgccctcatcccaaactgctttgttcaaacaaaaccaccttgtttcagtctccccaaatgtccagttcattatcttcctcataacccatggtccctattagggtaggatcatgagactaagacctatgagagccacaaatctggaccaaagtcccattccctgaacagagacccaaacgacgagggtcccagaagagagttcagtcctgatcagaaacccatggtgccttagtccttgaagaacaaaactctaggaagaagatgctggaaggcaaagggtattccccctctttccccacccgcgtctctgtggtgccatgggtgggcccaggtaccctgggaaaggtgggagagcagtcaagggtgggtgtgtgatctccactgggctcactgggcacccccgacacggggaagtgagagctgcccgactcctgagccaggcgtgggtgacaggaagaggaccttgcagctaatctgattcattagaaaccatacctgtttatgttttgtgtagctcatcacaagccgcttagccatatcacccccgttattaattcttggggtctaaattatgggtaacactattaaaacattatcagaactaatgagaaacaattacttagaaaatgagccgggacaagactgagttgggaacatcagtggtgatcactgtagattagtttaataaatcatcaggtgcaaggcaagactgactgtatgtatgcaaagccccgtcacgggaaaatgaaattgagattttttttttttgcataattttttcattaatctcaataggacccgtgtggtgtagattgctttattcccctaataccttgcctgaggcgggggggggggggggtgcccaataatgtcttcattgttttactgaggtcttaatgacaatctgtgacaacctcattttaatgtatagaggattatatcaatacagtcatgttttattgaaatggtgaagggaactccagtcagagtcaggcagtgtctgtgagcacaagttaggaagtttctcggcatccgggagcgttcccgtctgatgtcccagtgttagtcctcccggccgccctcccctcctctcctccagggacggctgggaaaacagtcctgcgggatgaagacttcaccgcctccgatttgaatttgaaagtaactccttccgtggcatatttcgctgggcagatagaacaaaccatgtcgttttcccccgtctctaaaatagacatattattatcattcacacttttgcacccggtcgttttgcgggagttcgggaaactgactttcttcattggggacattgtaattttctgatgatgccacgaggagaaaaaaaatacgggtttgttttaattggaaggaccttccgcttttatgatttcggtttaccttggaaaactgaatcttctgtgttttatttctttcctctagtactagaaaagcaatgaattaattgcacaaaacaggttctgagacggcccgcaggccccgagctcgtggacgcggccgagggtcgggtgtgacccgcggagccgctgccaggcttcccagctcgtcttcgcggggaggcgggaggcaggaccagaccccagcatttcagcgtgaaagtcttcgcctttctttccgcgctgtctttcccgcgggcggagcggcgtacctgagcgcggtccccacggaggatcagtgactttcccagaccccgcgggcgagcccgcgcttgggacccggcagctctgcgcgggctggttttggagggggtggtgttcgtttgtttaaattccagttgttatttggcagcatatcgccttccgagtcagtaagaattgcccacgacgtaaagagcgacttgcaggaaggggccgaagccgtcgttagcgcccgggcggcggcggccactcgaaccccgtttccgccaagcgcgctgcaacctgcggggcgagttcgttttgttttgccaaaatcatttggggacttctttgtcattcatgcccttccttttaaatgatttttatttttttccactgtaagtgaccggctgggtttgacttttgcttcttccgacggaagggcaccgcgagccggggtgggcggccccgcgggcaggaggagcgcggggtacacgcggtggccgcagacgccgagccctgcggagccccgaggcctcgtcgcccgcgcccccggtgcgcgcggagccggggccgaggccgggccaggaggagtgtggcggcccaggaggcctggactgtgggccctgctcgcccgcccgccgcgggccgcccggagcccgcgcgcctgtcgcgcagcccggctgtaatggtggcagatcaaaggcggccccgtgtccccgcggagcccgggacaatcccgcgcctttgtgcgctgttgctaggagcccgagaaactaagagaaagtgtcaggagcatgttaatcagactcgttacactgtaacaataacgtctctctcgggtctcccaggccccagtacccccgcgcaccctgcgcgcaggccggacacctgcgcagggcccttgcgcccgccctggggtcccgccggccctggggtccctgcagccccgaatccgcacccgagccacgcggaacgactagccccgaggggccccgcaggctcccggtgcagctccctggtcgtggtctccttgaccgaagccccggcctcacaccgcctggccgcgagcccgagggacgcagggacgatcccggtcccctgcttttcagtcctccagtcgaatcgcccactttgttcaatcacagtattcgaatcaagaggaaaatgaacattccctttatggtagctttttggttatgagttttggcaaaactgttaaatcaactttgccgatttcccttgggaatccctggaggccactctaagtggtaatcccaagtttaagaaggaaatggggaaattttgctgagagtaaagatgtcgccgaactttttgaagggatttgcttcattcattcatttagtcattcaacagacacctgttgaacccgactgggtgccagaggggccagtcacaggacttattccagatgaacttttcttttgaaattagaatgcccttgtggaagccaaaggaggagcagaggcctaaaataatgtcaagtgtcaaagcaaaaagaagtgccattggctactacagtgtgtgatgataacaagagaggtgcgaattaggaattaaaaacgtttgaaaaactacaggcc

SEQ ID NO: 6132 - DNA, 2207 bp, Homo sapiens
aaagggcggggcgcgcgcgtcgggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccatagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggtgggctgaacatatacagtggggttcttaaagacaaaccacaatactcaaagcaacttgttaggatgccagattgggacctgactccatttacagttcatgttaatcacaattttgttgttgttgtctcactggccagttattcccctaaaaaaatgaacgcttttccctttggatccaagcttatgattttatcatttttagtgtattacgaatatgggcttatgatttcacagggaggtaagatcctggggaaagatgggctgtgaggcgaaggtaggtctttaatgaaatggatctttcccaaatagacatattccctccacccttctcatgttagtaaatgtttcctgcttgttcatttatacagctgacaccacaaataattttaagaaaagccaggcctttaaaacatagtagcaacattaaggggtcatctctatttcactagtaatctgataaaacaacagagatggcatcaaaaaagaatactaagtattatattggcttaaaaagacactttctgaaaataaactttcgaaactggttactattaacctccacccctaaaacgaaacatccatctccttgaaccgctagacgatgaacacgaaagctgtcatcctgggtgaatgctgtgagtcaaccattaccggcaattaaaaaataaatgtgcagaaacacaagaccatccattctccccctttattttcccgtttaactgtttgccattgaggctatttccccctggaaatgtatggctgggacaggactccctcagtcataaacttgtagcgtctcagaagacacaatgcacccgagctggtgcatgtggcccctgcgagatttgcatcacattagagatgcggctgcaggtcagatgggtggtgtggttaacgggcttagtaaagctgttttgaagaggttaacccagcttgtagtaagggtaaataaacataacaaccagccattgttccctattcagcatgtactcttatattgaaggctaaagggtattgaagctgcagagggatcaacttgtgcttgccagaggacgccaatgaagtttgaaacaccaacaatcagagattttgtttctgttcctcattaaatcatgagcttttgtgccgaga

SEQ ID NO: 6133 - DNA, 712 bp, Homo sapiens
aatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgtcaaagacatctctctctctctttttctgtgtgtgtgtgtgtatatgtgtgtatatattttttctttgcccctcaaggatggacatttacataacaatgtatatttgccaaccatgacaatggtttttcatgacaatggaatggacactacttcctgataatttagggctcctcatagctgccctgcttctagagcactgcattattacttctgttcatttataaaagacacgagcaatagaaagcctgttgcagccccaggcatgctcaggaatatatggcatctcctttgctcctaataaatatattatgtgaacagcctca

SEQ ID NO: 6134 - DNA, 386 bp, Homo sapiens
ctccaagccatagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagggggcctttactttccaagggagtatgatcgacatgccattactgaagcaggcccagaacactgttacgcttgccacctccatcaaggaaaaatgatctgttaaatgaagctgtcatcaggaagcccgagaggtgaggagctgaggttagacaccaggagaggcaccatc

SEQ ID NO: 6135 - DNA, 470 bp, Homo sapiens
gaagaactgattgctgcctttaaagaacatcaacaattaggaaaggtaggtcggtattgctgctcttggctttgcattcagccttttccatcatcaccaggtcagcggtcacagagcatctcccgtgtacctggcaggtactgggtgctgggtgccaggtcctgggagtcaaagggggcctttactttccaagggagtatgatcgacatgccattactgaagcaggcccagaacactgttacgcttgccacctccatcaaggaaaaatgatctgttaaatgaagctgtcatcaggtgggctgaacatatacagtggggttcttaaagacaaaccacaatactcaaagcaacttgttaggatgccagattgggacctgactccatttacagttcatgttaatcacaattttgttgttgttgtctcactggccagttattcccctaaaaaaatgaacgcttttccctttgga

SEQ ID NO: 6136 - DNA, 610 bp, Homo sapiens
aatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtgggcagtgtgtgaagaaaccctgaaggtcgggcctcaagtaggtctctttctagatgcagtcgtttttggaggagaagactttcgagccagcataggtgtcaaagacatctctctctctctttttctgtgtgtgtgtgtgtatatgtgtgtatatattttttctttgcccctcaaggatggacatttacataacaatgtatatttgccaaccatgacaatggtttttcatgacaatggaatggacactacttcctgataatttagggctcctcatagctgccctgcttctagagcactgcattattacttctgttcatttataaaagacacgagcaatagaaagcctgttgcagccccaggcatgctcaggaatatatggcatctcctttgctcctaataaatatattatgtgaacagcctca

SEQ ID NO: 6137 - DNA, 1448 bp, Homo sapiens
aaagggcggggcgcgcgcgtcgggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtgggcagtgtgtgaagaaaccctgaaggtcgggcctcaagtaggtctctttctagatgcagtcgtttttggaggagaagactttcgagccagcataggtgcaacaagtagtaaagaaaccctggatattctctacgcccggcaaaagattgttgtcatagcgaaagcctttggtctccaagccatagatctggtgtacattgactttcgagatggagctgggctgcttagacagtcacgagaaggagccgccatgggcttcactggtaagcaggtgattcaccctaaccaaattgccgtggtccaggagcagttttctccttcccctgaaaaaattaagtgggctgaagaactgattgctgcctttaaagaacatcaacaattaggaaagacagtgtcttgctctgccagccaggctggagtgcaatggcgtgatctcggctccctgcaacctccgcctcccgggttcaagtgattctcctgcctcagcctcctgagtagctaggattacaggcgcacaacatgcctggctaatttttgtatttttagtagagacggtgtttcaccattttggtcaggctggtctcaaactcctgacctcatgatctgcccacctccgcctcccaaagtgctgggattacaggcgtaagccaccgcgcccagcccagaattttgtagttctttttatactgaattttattaaaaatacaaagcaaccatttctataattgtcttttttttcccccactttaggtcagtgggcctcaaaaaaaaagtgaggcaatttcttaccactaccttagggaataaagaattctctctaccgtagcacgcacctccctgcagcatcttgggcagaaataggtacacgaaacacatttagtaaacattatttagctaactggtttccaaattcctgacaatgctaaaaaaaaatttattagatgtacttttaacagtatatatgacatacttctgctgccttct

SEQ ID NO: 6138 - DNA, 2975 bp, Homo sapiens
cagtgggcggggcctccttgaggaccccgggctgggcgccgccgccggttcgtctactctttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaa

SEQ ID NO: 6139 - DNA, 589 bp, Homo sapiens
ctccttgaggaccccgggctgggcgccgccgccgatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaag

SEQ ID NO: 6140 - DNA, 8578 bp, Homo sapiens
gcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaagggtttatttagtcgacggaaagaggaccctgctttacccacacaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaa

SEQ ID NO: 6141 - DNA, 8708 bp, Homo sapiens
ggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaagggtttatttagtcgacggaaagaggaccctgctttacccacacaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaat

SEQ ID NO: 6142 - DNA, 981 bp, Homo sapiens
atggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttgatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaca

SEQ ID NO: 6143 - DNA, 624 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 6144 - DNA, 606 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 6145 - DNA, 636 bp, Homo sapiens
atggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcg

SEQ ID NO: 6146 - DNA, 1064 bp, Homo sapiens
ggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccacgccctctgcacacactgaatccaaactcttaaatgagatggcgatcaaagagcgcgtggagggccgagccaaagtcccgtacaaattcagggacagcctcaaacgtttctccttctcgcccactggaatgttgaagatcctgagactgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttgatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaca

SEQ ID NO: 6147 - DNA, 765 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttgatcttaccaacagtatcattacagctgtgttcctttcagtagttgccatcttggccatgcaagaaaagaaaagaaggcatttactctatgtcggggggtccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 6148 - DNA, 749 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctgagtcttatcttaggagcattagcttgtttcatcatcacccaagccaatgagtcatttataacaatcacaagtctggaaatctgcattgtcgttttttttattctaatatatgtgctaacccttcaccacttgctgacctatttacattggcccttacttgatcttaccaacagtatcattacagctgtgttcctttcagtagttgccatcttggccatgcaagaaaagaaaagaaggcatttactctatgtcggggggcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaa

SEQ ID NO: 6149 - DNA, 240 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggaagcagacaaagcaaatatgagcaactttaattga

SEQ ID NO: 6150 - DNA, 493 bp, Homo sapiens
agagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctgcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaaca

SEQ ID NO: 6151 - DNA, 1054 bp, Homo sapiens
gttggcattcggtggtcctggcagttagctgagcacgccctctgagccgctcggtggacaccaggcactctagtaggcctggcctacccagaaacagcaggagagagaagaaacaggccagctgtgagaagccaaggacaccgagtcagtcatggcacctaaggcggcaaagggggccaagccagagccagcaccagctccacctccacccggggccaaacccgaggaagacaagaaggacggtaaggagccatcggacaaacctcaaaaggcggtgcaggaccataaggagccatcggacaaacctcaaaaggcggtgcagcccaagcacgaagtgggcacgaggagggggtgtcgccgctaccggtgggaattaaaagacagcaataaagagttctggctcttggggcacgctgagatcaagattcggagtttgggctgcctaatagctgcaatgatactgttgtcctcactcaccgtgcaccccatcttgaggcttatcatcaccatggagatatccttcttcagcttcttcatcttactgtacagctttgccattcatagatacatacccttcatcctgtggcccatttctgacctcttcaacgacctgattgcttgtgcgttccttgtgggagccgtggtctttgctgtgagaagtcggcgatccatgaatctccactacttacttgctgtgatccttattggtgcggctggagtttttgcttttatcgatgtgtgtcttcaaagaaaccacttcagaggcaagaaggccaaaaagcatatgctggttcctcctccaggaaaggaaaaaggaccccagcagggcaagggaccagaacccgccaagccaccagaacctggcaagccaccagggccagcaaagggaaagaaatgacttggaggaggctcctggtgtctgaaacggcagtgtattttacagcaatatgtttccactctcttccttgtcttctttctggaatggttttcttttccattttcattaccacctttgcttggaaaagaatggattaatggattctaaaagcctaaa

SEQ ID NO: 6152 - DNA, 904 bp, Homo sapiens
ggcgcgggagttggcattcggtggtcctggcagttagctgagcacgccctctgagccgctcggtggacaccaggcactctagtaggcctggcctacccagaaacagcaggagagagaagaaacaggccagctgtgagaagccaaggacaccgagtcagtcatggcacctaaggcggcaaagggggccaagccagagccagcaccagctccacctccacccggggccaaacccgaggaagacaagaaggacggtaaggagccatcggacaaacctcaaaaggcggtgcaggaccataaggagccatcggacaaacctcaaaaggcggtgcagcccaagcacgaagtgggcacgaggagggggtgtcgccgctaccggtgggaattaaaagacagcaataaagagttctggctcttggggcacgctgagatcaagattcggagtttggacctcttcaacgacctgattgcttgtgcgttccttgtgggagccgtggtctttgctgtgagaagtcggcgatccatgaatctccactacttacttgctgtgatccttattggtgcggctggagtttttgcttttatcgatgtgtgtcttcaaagaaaccacttcagaggcaagaaggccaaaaagcatatgctggttcctcctccaggaaaggaaaaaggaccccagcagggcaagggaccagaacccgccaagccaccagaacctggcaagccaccagggccagcaaagggaaagaaatgacttggaggaggctcctggtgtctgaaacggcagtgtattttacagcaatatgtttccactctcttccttgtcttctttctggaatggttttcttttccattttcattaccacctttgcttggaaaagaatggattaatggattctaaaagcctaaa

SEQ ID NO: 6153 - DNA, 605 bp, Homo sapiens
tgcagatgtgcgtgcctgtgtgtgtttgcgcgcgcgcgcgcgtgtgtgtgtgtctgtgtgtgtgcctggagctgcgcttgcaggtctgagagtcctctgagaatgggttgggggaggcgggtgcaggaccgaggcctggaacagccaacaaagaggccctggaggagggtggggctggccggggacaggaggggtggccaagaaagtcgcaagaaaactccggcccccaagaaaaagagagggcatgggttgcggagccgacatcacggccggggtctttgctgtttagacgcctgggttcccggatcccagacacgcgcacgggcaggaagttagaccggagacagcgacccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccccggtgggtttgtctgcacttggtgctcctgcccacaccagccactttggtga

SEQ ID NO: 6154 - DNA, 2123 bp, Homo sapiens
aagaaaactccggcccccaagaaaaagagagggcatgggttgcggagccgacatcacggccggggtctttgctgtttagacgcctgggttcccggatcccagacacgcgcacgggcaggaagttagaccggagacagcgagtatagacagcccttctggataggggcagacgggtgggagctccgaaggggtgccggggcggtgatcgggaggtctccagcggcccgaaccagggtgaagaagaagcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactgaccacttgcttggagtgtgtgcttgaaaaaaccagagcaatactgttgggtattgtatcaggcttcagtacaaactggtaacaccaatgtggatcctgacagctttcagttttagcaaaaatacacgtgaaatctgactaccattt

SEQ ID NO: 6155 - DNA, 2330 bp, Homo sapiens
gtgtgtgtgtgtgtgtgtgtgagagagagagatgtgttggggtggggggactgcaggtcaggaagtcctgcagatgtgcgtgcctgtgtgtgtttgcgcgcgcgcgcgcgtgtgtgtgtgtctgtgtgtgtgcctggagctgcgcttgcaggtctgagagtcctctgagaatgggttgggggaggcgggtgcaggaccgaggcctggaacagccaacaaagaggccctggaggagggtggggctggccggggacaggaggggtggccaagaaagtcgcaagaaaactccggcccccaagaaaaagagagggcatgggttgcggagccgacatcacggccggggtctttgctgtttagacgcctgggttcccggatcccagacacgcgcacgggcaggaagttagaccggagacagcgagtatagacagcccttctggataggggcagacggcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactgaccacttgcttggagtgtgtgcttgaaaaaaccagagcaatactgttgggtattgtatcaggcttcagtacaaactggtaacaccaatgtggatcctgacagctttcagttttagcaaaaatacacgtgaaatctgactaccatttaa

SEQ ID NO: 6156 - DNA, 1934 bp, Homo sapiens
ggcggggcgtggcggcgggggatgcgcccctgcgcgagccagtgtcgcctgccctccttccgcacagcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactgaccacttgcttggagtgtgtgcttgaaaaaaccagagcaatactgttgggtattgtatcaggcttcagtacaaactggtaacaccaatgtggatcctgacagctttcagttttagcaaaaatacacgtgaaatctg

SEQ ID NO: 6157 - DNA, 3414 bp, Homo sapiens
agcggaccgagccgcagccgcagccgggcggcgggcgagaggcggcggcggcgggcgggccgcgggcagtcagtcgggcggcggcggcggcggcggcggcggcgatgcggcggccccgctgagtccgcccgctcctggcgccgggagccagccgcgcgaggcggcccgggccgggcggcagcatgcggagcggcgaggagctggacggcttcgagggcgaggcctcgagcacctccatgatctcgggcgccagcagcccgtaccagcccaccaccgagccggtgagccagcgccgcgggctggccggcctgcgctgcgaccccgactacctgcgcggcgcgctcggccgcctcaaggtcgcccaagtgatcttggccctgattgcattcatctgcatagagaccatcatggcatgctccccgtgtgaaggcctctacttttttgagtttgtgagctgcagtgcgtttgtggtgactggcgtcttgctgattatgttcagtctcaacctgcacatgaggatcccccagatcaactggaatctgacagatttggtcaacactggactcagcgctttccttttctttattgcttcaatcgtactggctgctttaaaccatagagccggagcagaaattgctgccgtgatatttggcttcttggcgactgcggcatatgcagtgaacacattcctggcagtgcagaaatggagagtcagcgtccgccagcagagcaccaatgactacatccgagcccgcacggagtccagggatgtggacagtcgccctgagatccagcgcctggacactttttcctactccacaaacgtaacagtaaggaaaaaatcacccacaaacctgctgagtttgaatcactggcaacttgcctagaaaagttcagatgatgggtccttgaactgtgtatctatttcatagggtaagtttgttgtctatgtttgtttttttatgctgaggctttaattcaggtgacttgctatctagacacctggggtggcgtgttttctttgggatgcataatacacaaaggccagggagcctttggcttggacccccagggagctattgaaacttttaaagtttgagtttaggagtaagaacatatctcagaccaccttagtcagctttgctgatgggatttagggccaggtcagagtttcttttcataactgcctgaaaagagagatggtgtgaaacaagattctgataatggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcagaagtgaggaaggcaaatactcagggtttgaagggagacctggccggcctgagggctggcagatgtgagggcaggacacctgggatggactcgtaggctgacccaggcccaaagggggctgcctgttcccaactctttcactctgtaacccattttaaaatgagtttttgaatcttgcctcaaattgacctacttggataaaatcagtgcttttcctaacttgattttgtttgacgtggttccctctaagagaatggtaggaattgaaactatttgtatatgttgaaatttgtaggggttcaggaacccatggcagaaacactaaactatttatttacaagtatgactatttttttttcaaagtaggcaattctttgtatattttaaggcaaataatcacttcacctctggtgccttccatgcgtcgcataagcactcttgtcaatcatggaattggaaaaaaagatgtacatttagttaaacaagataacactatttttgtagcatgattttagattgtgtccttttaatattgttttcaacaatggtagttttgaggttttggccattttctctttacacttcgtatgtattttaaagaagaaaaaaaacaaaaaaaattccctggctattcctctttcctctctgctgctgcttctcctgcatcttgttcctgcttatttaaatagtctgagagtaagagtatatttctgtgaaataattataagtcagtataattgcatttggcattttttaaccacttgctcagtttggagccactgctcacctcaaacagtacaaagaaagtggttccatattttacaaacagaagagtagcatcagagccctgacctcctgtctttgggtgtaaaatggtgagaggccggtgtccggctccttcccctgtggtttgggctggtgaactgagcccaagtgtattctctggcctgggccccttccagaatcagtgcgagcgtcctgcagaggcatggccttcctgccactgcagagtgggaagcttcctgggggacctcagccagctccggggctctcatcttccactcggatctcagattggttcgttgtggatgctctggctaggctcggcggccttttccaggcttcaggcctgaacaaaacaggctgtttgctgtgaggagctagatgacaccaagacacagacacgtactcttcaccggctccttttgcttctccttcctgcaggacgtgagttatgtctggtcccaaaacccttgagtaaactagctgagccattgcaaatgaaggtacagatggattgaaacataaaattgtagcttttggtgtccttctgaagggtcagaatatgtaattatttgataaccaaggaagtcaagtcagatggctaagtagtaactttccaatatgatttctccgtggtacttcacctggtggcacttttggggggcaatgttaacaactatcacattttactcatcaagtctctttcatttcggcagtttaaagacacaactgtgggctttctgaggcgatgcccgttgggcaaacttaggtttatgtgtttggtttttcagctgacgtggaagccctgggtgggcgtcccctggctggcctggcttttgggttcaagtctgtatgtatggagtgggttggggccccaaagctttgctgctattgatttgtccccgacagcaggcaaagcctcacattgccctcaattttccccctttcatttgaaggaccagtttttcatggtacttgtcttgatctttttcatagtgttcaaatctgtatttttgtatgtagagggaaataattttctcaacactaatcgttaataactattgtattaaattgtcatgaaggaacttgtttaataaatggacgtgtaagga

SEQ ID NO: 6158 - DNA, 8116 bp, Homo sapiens
agcggaccgagccgcagccgcagccgggcggcgggcgagaggcggcggcggcgggcgggccgcgggcagtcagtcgggcggcggcggcggcggcggcggcggcgatgcggcggccccgctgagtccgcccgctcctggcgccgggagccagccgcgcgaggcggcccgggccgggcggcagcatgcggagcggcgaggagctggacggcttcgagggcgaggcctcgagcacctccatgatctcgggcgccagcagcccgtaccagcccaccaccgagccggtgagccagcgccgcgggctggccggcctgcgctgcgaccccgactacctgcgcggcgcgctcggccgcctcaaggtcgcccaagtgatcttggccctgattgcattcatctgcatagagaccatcatggcatgctccccgtgtgaaggcctctacttttttgagtttgtgagctgcagtgcgtttgtggtgactggcgtcttgctgattatgttcagtctcaacctgcacatgaggatcccccagatcaactggaatctgacagatttggtcaacactggactcagcgctttccttttctttattgcttcaatcgtactggctgctttaaaccatagagccggagcagaaattgctgccgtgatatttggcttcttggcgactgcggcatatgcagtgaacacattcctggcagtgcagaaatggagagtcagcgtccgccagcagagcaccaatgactacatccgagcccgcacggagtccagggatgtggacagtcgccctgagatccagcgcctggacacgtgaggacctgcctggatcctcctccctcccgtcctcgtgcctgtctctcagtcaagttttctttcccttgtcctgtcagatttccatgtgattcagttgaattttgtcctctttggtaaaagttcattttgggaaagggtttcccgagtggcccagtgggcgggtccgcggtggagttgggaggcccacgttcctcagcgtttggggctgtggagcagccggcgtcactgcccaggtccacttgaggtcttacctgccctgaagcacaggcttcctttgactctgagccaccttgtcgtgtgtatttgtaacaagactttggattaaatggggctgctaagaggggggaaatatgaaggaatgaagggacagcattggaacggtcagtcggcagtggttctcaggcagccttaggcaccacctgctccaagtcagtgttgagtctgcgtgctgggatccagcccactcctcatcttccatgccagggcccccaggcagccagcaccagcccaaaggccacagggctggggaaagctgatgtcctgttaggatggctcccagggacctctgactcaaggaagggtgaccttttgtttcctactctgctgagaaatcacttgattcttcctcaaatgaatcaccttcctgaaccccagattcttctccaggaatatgggggccatcttgttatggggactatcttgttttccagtttcctgcctaccctaaatactttgaggctgaattgcagattttcagtcattttaccttctcaggtaaaagccatgaaagaaacaagcctactccaccagccaaagcacttgcccatttgctggcttcatgaaccgcaggtgggaggtgtttgtgttaaaaaacagcatgcacacgcgtgcgcgcacacatgcacacacacacccctctattttagggatgtgtgctaattttctaaatgcctgcaaagagttctaaaatgattctgagcagattcgtctaggatttgaaaatacttgaatttgcaccagaacacacccttccacccatgtttcagaaggcactaattgtcgctttgggcgcctcagtgtcataactgtagacatcattcttgggagttgttggggggaaaaatcctagctacttaaggtttctgattgattcttgataaagtgaagattattgtgtgtggtgaatgagttcagtgagtccccatgatgcagtagtttttttaaaaaattagagagtaattatatcttttatggaaaaaagttgttttagtttgtcaggttttccctctttgaactgtttttaatgtttacaaacctcactttagctctaacattttgtgtttagccctcaccaaaaagcacttactgtggcaggaagattttgcagtaacatggagaaatccccaagatcaagtgctgacaaatgttgacagctttagcagcgtactgtgtaataaataactccgagggggcggcggggggtctgtgcaagaaagcgtcaccttatggacatgtggcgtctcattccccagaaaaggacagcatctgagctcacagtgttgatcaggcaacactgctgggctgggggtcggagttggggttagcttcctgcaccaacaccttcagtacgatctgagttgggagcagtgtcccaggctatgtggctgagcaccacgtctgcctcaggggctgaccctgctagcctgttaacaactcgtctcccctctgctcccacagagagggcagccaggccagctcacagctgggtgtgctgcctgtcaggtctgttgagtgtgtttgcaaagtcaaaattgggcttatctctctttgagagttccttttaaaatagggccacaaaggctcagccttgcattaaatggggcccacttggaaggaccatcctgagctttatcagaaatctcctgctgggaatcatgttacttggcccccaaaaaaggccatctttgaagtgagattgaaaacaagaacaccattcaggtgggcttgttgcccaagttttcccagctcacttcagtaaaaccacttgatcatctggtgaaagaggggggcaggtggttggcctcctgaggatatgttgtcagctgcaagaaatagttctgaagtcactgaaactaaatgcagatgaatgaccaaaaaggatgacacgccagagagtgacttaggagttaatttgcatcttcgtgatagactcttcagaattatttatgtccctgtaactatttaatatcctttgtgccgtgaggctcctcggtggttttgtaaatgttctccttgtatttaattaactcccactagaaccggaagtggtgctatggacgctttctagttgatgtaatgtgtggttgcacatgtcatcatgtatagaccacgtggtgacgaaagttctggagggaatagggttatccaaggtgaatatgaagacgcctatatttttcttatattgcctctatatgcaaacagaagacaatcgatatctgggggccttaaaatgacctcttggcaaattgaaggaagcgtttttgcgtttaatagtttcaatagggaccaatatcagtttggtttggggcatttgaaggctgagcgaccttagtttttctcagtgttctggtgggacgatattggttttcacatttaaagcaaaacttgaagaaactgcagttgctgtgtgcatttgggttttttcctggacactgtacagctgaaaccctcaagcatttggtggaacctctggtggttttagatggatgcaaacactgatgtcctcagagaaagtttattttggcactgattgggtggatttggtattttttccctctgattctctttgatatccttctttcacactgctgaaggcatgggagggaaatatgttttccctgccttaaagagggattacagtcatgaaaggctggagatacttgttggccccacataaagctgggaagaacagatgcagtttcagattaaaatctcgtcagagaagtttgatttgaagtaaacagccatccgagggaggtgacttttgtctacagaaaaagcaagaatgtggcagcctgcacagccccaatacacatcttccttggcaatgtgagctgaagccagcatgggcaagtccggcccagctctgagcgcttggccctgggaagccagcggcacccccagcccttcgggccctgttactgtcccctggcaggaaggctcacgcctgtgggcagccagggaatgtgtctgacctccaccctatgtcgggtgcttctgggacagcttcgtgactcagttgaaaacattctgactctcttcaagtttgcagttacatctgtggttcttggaagctgtcctagtgagtcagccttgggttaagcctgaggagaccaagctccaacacctttgtgcactcatgtacgtgaattcttgcttgcagtgaatgagacctgaacaaccctagtgggtgccatgtcctgcgtgtggcccaggcgtaccttttcttgtagattcacatgagaaacccgtcacctatccatgtgctctgagaggtggactgaggtctaatccctttctgtgccagattttctgtgggttggtcttagcacctaggagatgaatagagcatggagacacctgaacaatttagtgattctgcaaggcagtgatgatttaagggttcctattgtctcatctgtgttcaaaacaaaacagtcatgaagtctttgtgccactgcctgactgtcatcttctccagatcttgtttacagagtaataatgacgttaaacaggtatcagaaaggggaaaaagtttctaggccaagagctgctggtggattctcttgagcagaataacaagttgcttcctgctccagggactgccattagcttgtgaagtctctaggtgccttgttatttcctagtgaagttgcagaatccagggttttttccaggtttgtcttattttatcagcacccacgtccaggcccaacagcttggtaggctggtgaggtccacacacggccaggtctgggagataagggaggaagcagtggcctggaacaccccacctgtctgctatcagcactagacagctcaggctgtcttggaaacgtgtactttgttaactgccttcctgtcctcttgtctttgaaagctgtctcgcgttccacagtcagcttgagggcaagagtgggatgctggggacaggtctttcccgtcctgtgggtgagctcctggcatctggctcaggaacatgtgggtccagcaggtgactctgaagctggcttggctgccatctcagacaggacgcaggcctgacaccctcagcttttagctttgtaaacttccctggcgctttgtagaatcttgtgtttcttctcttctcagcagatatcattcaagtcacaagaactgtctggttgagaaagtaatttaaaatatttgaccttttatgtttcttttatttagaaactgtgagagaaaataccgtcaatatctgttaggtctagaaaaattttcttccgaaagtgaatgttctgtttaattcttcttcatgcaagtgagtggcattttgtacactctttagcttgaagcggagtgggtcctattgtattttcccttcttttgtctggaatatattctttttccatttggatacagtttttcaacctttgggatttttttttcctttctagtttttcctactccacaaacgtaacagtaaggaaaaaatcacccacaaacctgctgagtttgaatcactggcaacttgcctagaaaagttcagatgatgggtccttgaactgtgtatctatttcatagggtaagtttgttgtctatgtttgtttttttatgctgaggctttaattcaggtgacttgctatctagacacctggggtggcgtgttttctttgggatgcataatacacaaaggccagggagcctttggcttggacccccagggagctattgaaacttttaaagtttgagtttaggagtaagaacatatctcagaccaccttagtcagctttgctgatgggatttagggccaggtcagagtttcttttcataactgcctgaaaagagagatggtgtgaaacaagattctgataatggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcagaagtgaggaaggcaaatactcagggtttgaagggagacctggccggcctgagggctggcagatgtgagggcaggacacctgggatggactcgtaggctgacccaggcccaaagggggctgcctgttcccaactctttcactctgtaacccattttaaaatgagtttttgaatcttgcctcaaattgacctacttggataaaatcagtgcttttcctaacttgattttgtttgacgtggttccctctaagagaatggtaggaattgaaactatttgtatatgttgaaatttgtaggggttcaggaacccatggcagaaacactaaactatttatttacaagtatgactatttttttttcaaagtaggcaattctttgtatattttaaggcaaataatcacttcacctctggtgccttccatgcgtcgcataagcactcttgtcaatcatggaattggaaaaaaagatgtacatttagttaaacaagataacactatttttgtagcatgattttagattgtgtccttttaatattgttttcaacaatggtagttttgaggttttggccattttctctttacacttcgtatgtattttaaagaagaaaaaaaacaaaaaaaattccctggctattcctctttcctctctgctgctgcttctcctgcatcttgttcctgcttatttaaatagtctgagagtaagagtatatttctgtgaaataattataagtcagtataattgcatttggcattttttaaccacttgctcagtttggagccactgctcacctcaaacagtacaaagaaagtggttccatattttacaaacagaagagtagcatcagagccctgacctcctgtctttgggtgtaaaatggtgagaggccggtgtccggctccttcccctgtggtttgggctggtgaactgagcccaagtgtattctctggcctgggccccttccagaatcagtgcgagcgtcctgcagaggcatggccttcctgccactgcagagtgggaagcttcctgggggacctcagccagctccggggctctcatcttccactcggatctcagattggttcgttgtggatgctctggctaggctcggcggccttttccaggcttcaggcctgaacaaaacaggctgtttgctgtgaggagctagatgacaccaagacacagacacgtactcttcaccggctccttttgcttctccttcctgcaggacgtgagttatgtctggtcccaaaacccttgagtaaactagctgagccattgcaaatgaaggtacagatggattgaaacataaaattgtagcttttggtgtccttctgaagggtcagaatatgtaattatttgataaccaaggaagtcaagtcagatggctaagtagtaactttccaatatgatttctccgtggtacttcacctggtggcacttttggggggcaatgttaacaactatcacattttactcatcaagtctctttcatttcggcagtttaaagacacaactgtgggctttctgaggcgatgcccgttgggcaaacttaggtttatgtgtttggtttttcagctgacgtggaagccctgggtgggcgtcccctggctggcctggcttttgggttcaagtctgtatgtatggagtgggttggggccccaaagctttgctgctattgatttgtccccgacagcaggcaaagcctcacattgccctcaattttccccctttcatttgaaggaccagtttttcatggtacttgtcttgatctttttcatagtgttcaaatctgtatttttgtatgtagagggaaataattttctcaacactaatcgttaataactattgtattaaattgtcatgaaggaacttgtttaataaatggacgtgtaagg

SEQ ID NO: 6159 - DNA, 1173 bp, Homo sapiens
cagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctgctgcagggccacgggcaatcaggaggaccacatccgctagatctactctcccactcagcaaaggtccagccccagccctggcctggcttgacccccccgggctggcatactccagccgctgtcccctgggttccagccccagcgcctggcttctggtcctggttgctctggttcatctgcttccactccctgggtagcagtgacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 6160 - DNA, 725 bp, Homo sapiens
agcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 6161 - DNA, 1200 bp, Homo sapiens
gttagagaagggggacacaaatgtcttcaggcttaggtccctgggggctcccagtcctgcccctgttcctctactcacatcccagctcctcccagtttcttttcggacctcctcctctccccttccttctctattccaggctgggttgggctctaagcaaggggagggattagagcctccttcctctctgcccctccccatgggtctctagggggctggtgcaggcagcagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 6162 - DNA, 1106 bp, Homo sapiens
gttagagaagggggacacaaatgtcttcaggcttaggtccctgggggctcccagtcctgcccctgttcctctactcacatcccagctcctcccagtttcttttcggacctcctcctctccccttccttctctattccaggctgggttgggctctaagcaaggggagggattagagcctccttcctctctgcccctccccatgggtctctagggggctggtgcaggcagcagcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcttcacggcctccatctctgcctacatggccgcggcgctactggagttcttcatcacacttgccttcctcttcctctatgccacccagtactaccagcgcttcgaccgaattaactggccctgtctggtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattct

SEQ ID NO: 6163 - DNA, 818 bp, Homo sapiens
agcagaggcactctgggcagctgggtgagggcccatctgggcaaggcccccagcgcctgccttctctcccggggccctgtgggcaagcctcctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggacttcctgcgctgtgtcagtgccatcatcatcttcctggtggtctcctttgcagctgtgacctcccgggacggagctgccattgctgcttttgtttttggcatcatcctggtttccatctttgcctatgatgccttcaagatctaccggactgagatggcacccggggccagccagggggaccagcagtgactctggggctacctggctcctaggcccagccagccagagaggacagtggagcccagacacgtctccttgggattcactagcccccagcccgccaaaccccaccccagccctacacagcagtctggcctgagacgtcactggggacttatctgtggagcctggtgctccaggatgtggcttctcatgaagctctggccagaggaggggaacttattgggggagggggggtggaggggaggaatctggacctctaagtcattcccaaattaaaatattcaaattcta

SEQ ID NO: 6164 - DNA, 3863 bp, Homo sapiens
cactttgagtctcattcaattcaaagatcatggtcctcagagaggcctttcctgaccactcagtttagtagtggccatttaagtagagcacccaattctccatccttttttccttctccttcctcttctcctcctcctccatcttctttttttttttaataaatttatcaagccaccagaaatgctgaatccattattttcgtatcatattttcacgtcacttatcactatctgaaattgctatccatctgttttcttgtttattgtctgtctctgttactagggatcctgtgattttgggtagtacttggctgtcacccaagtacctagaacggggttcactgcacaccgaaagtacgcaaaaatactaagtgaatgaatgtcaggaggatgaaagatggagggaggtgagaaatccatcaaaggctcacagaaagaactcaattcttggatgaaagtcggaagaatcccaacagctaacaagcaaatttgctgagagggggcggggcgggccaagggcgggggcgggaaggggcggagtcaggcggaagccggggagaaggcccaggaagtgacggccgcctcccggctaccggggacttctggagtccgagaagtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctgttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggatttttatattactttgggaacaggatgtgtgtttttgttggcatccatcatttttgtttccacacatgacaggacttcagctgagattgctgcaattgtgtttggatttatagcaagttttatgttcctacttgactttatcactatgctgtatgaaaaacgacaggagtcccagctgagaaaacctgaaaataccactagggctgaagccctcactgagccacttaatgcctaaagactctggggagcagatgttacctaaggtagtgaccctgcattgtggtgcctgagccctggcagaagctcttgtaaaatttgttaattgtttaaaccacttcttttggagagcaaggggaaggtcaagaaggcagttttatcaatattgtgtcagtcaccacaaagtaggccagataagttaaaaaaaatttttttttaaataataattgaaacttatctcaaatggagattttggtgggaggaggagaaaacaattgtttttaaatcacacagctcaacggttgataaatgattctgtcattctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactaaaattaatacagctctgtgggtcttccttagtgttttctttgaagccaatctgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaagtaaatatccagggaaccctgcccagactaatactgttggtggcataagagaatcaagccattctcaagagataacttcataaccagaattgtctgttggctagcagctgtcacagataggcagggcacttgggatatgacctttctgtccaggtgattcacagactagacctttcttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtgtcttagatgggttttaattgcatgaatgtggctaatgtggttctcagaaattggtcagtatggcccaacatagcttctgctctgtcttactgactcaatacctttaggatttgtatcagagtttggatactagtgttagtggtggtgtcaccactacttaattgggagataatgaaaccaatcatggatgctgtttttattgggcatgtcatctaagagaggagaaatagctgggttttgggtctaattatgaataaggactgattcagaaaacgagtttatggtaggtagactaaagtttcacatcagactgtaccattgtgatttagacctatctaaaattcagagcatatcatctgggctacctcagggtcaccacccatgtattgggcttagtcaggattgacagatacattctcagctggcctgtcatataaaacatactgtcattgagcttaagctccgcttgttctgaggtttcacctccatgtgtttcattggtgcaaaagtggatctcttagttggtcacttaattctttctttttcagaaagatagtatgttcactggtatatttggtcactcttagaaccttccttcacattgttttttatgggacccatgaatggttagcctttcttttctattgtagaaggaaataaataggagtaaaaagaccattgtagtaaataagttcaaggggaacttgggaccagaaaccactgttatgtacaaaaaaatggcaaattcaataaactcaaatttaaaataatttttaaattaacagttatgataaattttatattttatacaaatagattgcttagaatggttctcaagaattataagagaaatgaactcacagtacaaaaattttataattactatacttgtgttttgtttgggggctgggaaatgtatttttacattgtagccaatcattttatatttgtcaatttaaatcttatgggtcttttttttttatctctcttgatgtcagattttatagtctttttaaataaatccatttaattaaaacgtt

SEQ ID NO: 6165 - DNA, 2038 bp, Homo sapiens
agtctaacttccgcgcatctacgagggccgggactgccgctacctttctggaaggcgccggccggccagtcaccggagggatcccgccagaggcggctccgcgtctccagcagcggggcagggacccgggcgccccgccctcgccagcgcccgcccccgcccgcccccggcccgccctctgtatctggcccctgggcagctgcccggggaggcggccagcgagctggggccgcgcaatgtcgcacggagccgggctcgtccgcaccacgtgcagcagcggcagcgcgctcggacccggggccggcgcggcccagcccagcgcgagccccttggaggggctgctggacctcagctacccccgcacccacgcggccctgctgaaagtggcgcaaatggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcggaacttctgcactatttaatcggtaccctgctcctcctcatcgcctccattgtggcagcttccaagagttacaaccagagcggactggtagccggagcgatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcggccagttgcacaaggatttcttattgaaccagatgaaggctgtaaaacctggcctgaaacagtttccattcgagcttgtgtctggcccatggccctccacccgtgctctgtgtgtgccccttgctgaactgctggacttcaggttttctctccatcttgggggatagtatagcagggcagagttttaggtaaacatgtgcaggttctcaattatattcacgtcctccttctcctgcaataccaatcttctcattttggaaagagctttagagcaagctaagggttgtgtttacactatgatgattaatgatctcggcctaaatgtgctgtttcgctgatcttgagctgctcagttggctagaaaaaggagggatggaacaatgtttgagcaaccccgtgtgcaaggacctacattcacaaccacatctaatagcgatggtagtgactgcaagggggcaggttataggaccacatttttagaaatgaaatcggggctccatccccaggcacagggcaagccagtgaggagctgggctcaggatctaggtctgcctgactcccagccccatccttgcctctgctgagtgttgccggaaatggaagcagcccctgtgggctttgagctggagctctggggctactcttgtggctgctggccagctcggggcatcgggttctgtctgggatgatctaa

SEQ ID NO: 6166 - DNA, 1214 bp, Homo sapiens
ccgggactgccgctacctttctggaaggcgccggccggccagtcaccggagggatcccgccagaggcggctccgcgtctccagcagcggggcagggacccgggcgccccgccctcgccagcgcccgcccccgcccgcccccggcccgccctctgtatctggcccctgggcagctgcccggggaggcggccagcgagctggggccgcgcaatgtcgcacggagccgggctcgtccgcaccacgtgcagcagcggcagcgcgctcggacccggggccggcgcggcccagcccagcgcgagccccttggaggggctgctggacctcagctacccccgcacccacgcggccctgctgaaagtggcgcaaatggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcgatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattga

SEQ ID NO: 6167 - DNA, 1174 bp, Homo sapiens
ggcctccaccgccttccccggctgcccggcagcctcccctcgctcgctctcctcttcctctagggccccagcgcagctcgggagcccgcgcaccgaggcgctaggggcaccgcgcactagagggacacccgccgcgcctggacagcccccggcgggcgcccccctcgcacctcctgccccgcgcgggccgcgctcccctcccccgcgcctgtgtccccagggcgcagggccgcgcgtccagccccagacccgccggggtccctggggacgcgccagcccggcagtggctcgacgatggaggagccgcagcgcgcccgctcgcacacagtcaccaccaccgccagctccttcgcagagaacttctccaccagcagcagcagcttcgcctacgaccgggagttcctccgcaccctgcccggcttcctcatcgtggccgagatcgttctggggctgctggtatggacgcttattgctggaactgagtacttccgggtccccgcatttggctgggtcatgtttgtagctgtattttactgggtcctcaccgtcttcttcctcattatctacataacaatgacctacaccaggattccccaggtgccctggacaacagtgggcctgtgctttaacggcagtgccttcgtcttgtacctctctgccgctgttgtagatgcatcttccgtctcccctgagagggacagtcacaacttcaacagctgggcggcctcatcgttctttgccttcctggtcaccatctgctacgctggaaatacatatttcagttttatagcatggagatccaggaccatacagtgatttaccattttgataattaaaaggaaaaaaaaaggaagactctcactgtaaaaacagctgtaggtataatgtatattcccagagaattgtatttaactaattaatgttttttatattcttaaatttgctcacaaattgtggtttgttacaattaaactggatacttatttgcaaagtgttgtagcttataatgaactcttaagtatcttattaatgtattaatgtcttcatagatcatattttcttagacaatgtttaaatagataaattgctaatattgagaatgtgtcaagtttgtaaacctaacttttaagatgccagattcttttttgattaaatgttgcaaaatcccaagtaa

SEQ ID NO: 6168 - DNA, 1444 bp, Homo sapiens
tgcctccccaccattcaccaggctccactgcactggctcattcctgcctcagttgtgcttcttttccctggaaagttctttctgtagatctttaaagggtgatttccttctcaacattcaggtgtcagctcgtttcactttcctgaccatgcccatccactcagagatcactcaaaatcccattaccctattttatttctccatcatatgtatcactatctgaaactatcttgttgttgatgcaggctattttcttgaccccttcatgggactcccaacaggggtaccccatttactcagcctgccctgctcaacctcttgcaggagggagcacacgagtgaacgagtgcaggaaccagctggctgctttagtgctgtgaggagtaaactccatgcaggccctgcagcagcaaccagtttttccagatttgctcaaagcaatcccagtgagcatccacgtcaatgtcattctcttctctgccatccttattgtgttaaccatggtggggacagccttcttcatgtacaatgcttttggaaaaccttttgaaactctgcatggtcccctagggctgtaccttttgagcttcatttcaggctcctgtggctgtcttgtcatgatattgtttgcctctgaagtgaaaatccatcacctctcagaaaaaattgcaaattataaagaagggacttatgtctacaaaacgcaaagtgaaaaatataccacctcattctggctgactaaaggccacagctgagcctggaactgacccttccttcatcctcaacctgctgtcctccagaaagcaccaaggaaaaagcagagaatgacagcaaacagatcactaggcctctgaccacaggtgctgagtactcagcagccctcatataataggtttgaaagtactccttaaaataaaacactgtttccctttggaactatttacaaggatgaaacaaccgtatacctgagaaataacttgctctggtgtcaattcgctattcgccagcagacatcagaacacaccgagtttccagatgctggtttttccccttaaatcaggaaatacacctggacaatttctagaagactacaattcagtctagccacaaaggggattttttttttttggtaacaggctagagcccggttctgtaagtctttagctgaaatggtccagtacaaaagcactggaaatgagtgggctaggaggacaaggaccgtctcctgcgtgaggagttggttggaggtccccaaggccaggtaccccctgcactcttattggattcctctctgtcttcttggagttttgaaaaactccttcgaacaccaggcttttttctttagaaaacaagtctccaatcgttctctgttccgtagaaagagaaagaaaacctggagcagctgctgaaaaatctaatgaggaactaagaggcaaacccacca

SEQ ID NO: 6169 - DNA, 2359 bp, Homo sapiens
aggagatacttgaaggcagtttgaaagacttgttttacagattcttagtccaaagatttccaattagggagaagaagcagcagaaaaggagaaaagccaagtatgagtgatgatgaggccttcatctactgacatttaacctggcgagaaccgtcgatggtgaagttgccttttcagctgggagctgtccgttcagcttccgtaataaatgcagtcaaagaggcagtcccttcccattgctcacaaaggtcttgtttttgaacctcgccctcacagaagccgtttctcatcatgccaagccaacagaagaaaatcattttttgcatggccggagtgttcagttttgcatgtgccctcggagttgtgacagccttggggacaccgttgtggatcaaagccactgtcctctgcaaaacgggagctctgctcgtcaatgcctcagggcaggagctggacaagtttatgggtgaaatgcagtacgggcttttccacggagagggtgtgaggcagtgtgggttgggagcaaggccctttcggttctcattttttccagatttgctcaaagcaatcccagtgagcatccacgtcaatgtcattctcttctctgccatccttattgtgttaaccatggtggggacagccttcttcatgtacaatgcttttggaaaaccttttgaaactctgcatggtcccctagggctgtaccttttgagcttcatttcaggctcctgtggctgtcttgtcatgatattgtttgcctctgaagtgaaaatccatcacctctcagaaaaaattgcaaattataaagaagggacttatgtctacaaaacgcaaagtgaaaaatataccacctcattctgggtcattttcttttgcttttttgttcattttctgaatgggctcctaatacgacttgctggatttcagttcccttttgcaaaatctaaagacgcagaaacaactaatgtagctgcagatctaatgtactgaaaggcaaacctttctataattttacaagggagtagacttgctttggtcacttttagatgtggttaattttgcatatccttttagtctgcatatattaaagcatcaggacccttcgtgacaatgtttacaaattacgtactaaggatacaggctggaaagtaagggaagcagaaggaaggctttgaaaagttgttttatctggtgggaaattgcttgacccaggtagtcaaaggcagttgactagaatcgacaaattgttactccatatatatatatgtgtgtgtgtgtgtgtgtgtgtgtgtgtaagatgtcttcctatcaaaaagatatcaaaggcacatggaatatattttaataaaaacaaataatatctctaatatatccacacatttgttgccagatttcagaaaactgagctgcaatcgctttcctaaaacagtagtgtattaaatgaacatctataaaatgtatcaacacacattttaaaaaatttgtttaaagtatactcttaggccaggcgtggtgactcacacctgtaattccagcacttcaggaggccaaggtgggaagatcatttgagttcaggagttcgagttacagcctgggcaataaagtgagaccctgtcactaacaaaattaaaaaataaaataaatataaaatataggctttaaaaaagcatagtcttattaaccatgtctgttggtcaaaatctgcaaactctaaaagaagaaaagaagaaaaaaccaagcttagggtatttttcctcccgtgcctgagtcccaattacattcacgacagtactttcaatgaacataattgttaggaccactgaggaatcatgaaaaatgatctctgcttagtacatttgatgcaaaatgacttattaggggctgtttttctagctatagtgtctcgagtactaatatgcaattatgaaaattatattaaatctgggattatgacggtatcactgtatcatcttggtcttgttctggctgtcaccaagcatgacccaggtcaactttttttttcccctgaattacccatcaaattgatctgcagctgactaaaggccacagctgagcctggaactgacccttccttcatcctcaacctgctgtcctccagaaagcaccaaggaaaaagcagagaatgacagcaaacagatcactaggcctctgaccacaggtgctgagtactcagcagccctcatataataggtttgaaagtactccttaaaataaaacactgtttccctttggaactatttacaaggatgaaacaaccgtatacctgagaaataacttgctctggtgtcaattcgctattcgccagcagacatcagaacacaccgagtttccagatgct

SEQ ID NO: 6170 - DNA, 738 bp, Homo sapiens
atgccaagccaacagaagaaaatcattttttgcatggccggagtgttcagttttgcatgtgccctcggagttgtgacagccttggggacaccgttgtggatcaaagccactgtcctctgcaaaacgggagctctgctcgtcaatgcctcagggcaggagctggacaagtttatgggtgaaatgcagtacgggcttttccacggagagggtgtgaggcagtgtgggttgggagcaaggccctttcggttctcattttttccagatttgctcaaagcaatcccagtgagcatccacgtcaatgtcattctcttctctgccatccttattgtgttaaccatggtggggacagccttcttcatgtacaatgcttttggaaaaccttttgaaactctgcatggtcccctagggctgtaccttttgagcttcatttcagttgccctttggctgccagctaccaggcaccaggctcaaggctcctgtggctgtcttgtcatgatattgtttgcctctgaagtgaaaatccatcacctctcagaaaaaattgcaaattataaagaagggacttatgtctacaaaacgcaaagtgaaaaatataccacctcattctgggtcattttcttttgcttttttgttcattttctgaatgggctcctaatacgacttgctggatttcagttcccttttgcaaaatctaaagacgcagaaacaactaatgtagctgcagatctaatgtactga

SEQ ID NO: 6171 - DNA, 722 bp, Homo sapiens
attttttgcatggccggagtgttcagttttgcatgtgccctcggagttgtgacagccttggggacaccgttgtggatcaaagccactgtcctctgcaaaacgggagctctgctcgtcaatgcctcagggcaggagctggacaagtttatgggtgaaatgcagtacgggcttttccacggagagggtgtgaggcagtgtgggttgggagcaaggccctttcggttctcatgctattttcttgaccccttcatgggactcccaacaggggtaccccatttactcagcctgccctgctcaacctcttgcaggagggagcacacgagtgaacgagtgcaggaaccagctggctgctttagtgctgtgaggagtaaactccatgcaggccctgcagcagcaaccagtttttccagatttgctcaaagcaatcccagtgagcatccacgtcaatgtcattctcttctctgccatccttattgtgttaaccatggtggggacagccttcttcatgtacaatgcttttggaaaaccttttgaaactctgcatggtcccctagggctgtaccttttgagcttcatttcaggctcctgtggctgtcttgtcatgatattgtttgcctctgaagtgaaaatccatcacctctcagaaaaaattgcaaattataaagaagggacttatgtctacaaaacgcaaagtgaaaaatataccacctcattctgggtca

SEQ ID NO: 6172 - DNA, 3479 bp, Homo sapiens
agcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagcctttgcaaaatgttagcacagtgctgcagaagcctaatcctctctataatcagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatc

SEQ ID NO: 6173 - DNA, 3440 bp, Homo sapiens
acttccgctccacgcagcgcctgtgctgccgcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatc

SEQ ID NO: 6174 - DNA, 3987 bp, Homo sapiens
gcgtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaagcaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagcctttgcaaaatgttagcacagtgctgcagaagcctaatcctctctataatcagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatcaatgttgaactgctttttctttcgttctgttagacatttgagaccatttggggaaaaaataattatagtttgggcaaagtaatttttataaataatttaaaattatttaatgacttctctattctttcctatcagactctactgttaggaattaaaaatgaagcagcaaagatatcctgacctgctccattcttgctaatgttccatctacaacatttctaattaggcagaaattcatgtacttcagctaagtggtaatgaaaagtgattcatttgctgaataagagatgagagtgagtgtaattagctgactgcggtttttaatctttcaacaattcaatgtgtttaacttagtttcaaagaataggagctttcaagtgttgttacttcagagcaatcaagccagcctctggtggccgcatagtagaatatggtccctgatatttaaaaccgatcatcttaagtaaattttttctttaagaagtatatcttcactttctcaaatatgtatggttcttagacgaagtaaatgtttatctgaacctt

SEQ ID NO: 6175 - DNA, 3344 bp, Homo sapiens
gtcaccggcggcgccgctgctgtggcaaaggaaggagctgactgggggagttcgaggcggcgggcggcggtgaccccggcctggaactgccccgcaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagcctttgcaaaatgttagcacagtgctgcagaagcctaatcctctctataatcagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaaggtaactggaatgtatatacttttgctaatgttccagcaacactgctattatactatccaaatttttattgtaacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatcaa

SEQ ID NO: 6176 - DNA, 2346 bp, Homo sapiens
gtctcgacgtgtcaccggcggcgccgctgctgtggcaaaggaaggagctgactgggggagttcgaggcggcgggcggcggtgaccccggcctggaactgccccggtacggaagtgttccggggtccgtggggagcaggagagggaggcggcggaccgtcccgcgcggggcacgatgttgaacatgtggaaggtgcgcgagctggtggacaaagccaccaatgttgttatgaattattcagagatcgagtctaaggttcgagaggcaacgaacgatgatccttggggaccttctgggcaactcatgggagagattgccaaggctacatttatgtatgaacaatttccagaacttatgaacatgctttggtcacgaatgttaaaagacaacaaaaagaattggagaagagtttataagtcgttgctgctcctagcttacctcataaggaatggatcagagcgtgttgttacaagtgccagagaacacatttatgatttacgatccctggaaaattaccactttgtagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaagacttcagtgcctagcagcaagtcatctggtgaccttgttgatctgtttgatggcaccagccagtcaacaggaggatcagctgatttattcggaggatttgctgactttggctcagctgctgcatcaggcagtttcccttcccaagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacagcctttgcaaaatgttagcacagtgctgcagaagcctaatcctctctataatcagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgg

SEQ ID NO: 6177 - DNA, 7760 bp, Homo sapiens
ggcggagttctgtcgccgggatccttccgctgggctcagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgtagttaacatgctctttctcatcatgaattataaaggtgcccaaattatgggtatcttgatttttttcaaaaattggttgtgtgaatccagctcttgcttatggctgagaatgttcctaaagttcatttcactatcccttaatcctcaatagctacacatacccccttgcctagttagtcttgcactgctttacaactctcttaggcaaattacctaacataagctccacagaagagttttttaaaacttaaaatccctgtcccaccaggtgtggtggctcatgcctgtaatcccagcactttgggaggctgaggcaggcggattgcttgaggccaggagttcgagacaagcctgaccaacatggtgactccatctctactaaaaataaaaaatcagccaggtgtgatggtggatgcctataagatcctagctgctactcaggaggcaggaggctgaggcatgagaatcacttgaacctgtgaggcaaaggttgtagtgagccaagatcacgtcactgcactccatcctgggtgacagaatgagactcttgtctcaaaaaacaaaaaaacctatttagtttcatccaggacattaagtgaaagtgtttaatgtgagtgcaggtcagtgaagaatacaatggtgcccctgctttgatttgtgggaggtgccatcagttttccccaccactgcttttgcaccctcagtgcaaatatcaacacagagaaaaaaaaaataataatagtattatgaaaacattgactctgtggagaccctgtgggttctgcagagtatactttgaaaactataagattatgagttctataaaataccaagtacagatgaactagaaaacaagcatatatccacaattaccagaattttcatagtattccttttagtagatatgccatgacagttacttagccaccccatgccatcctgttgggaatgccactacctttgaatttggagccatcagtctatctgaggcaaacctcagaaattacctgagccagaatcatgcacttagcactgagttcaactcagtcttaacgttgcattttgttgcatcacttttgcagccagtaaacattctgtttagaaatagttgctattgtggcatcattcacagttgcaatttttctcctgtgctgtcatatgcctgtgcgaagtgtattaaatgaatcaaatattagaaa

SEQ ID NO: 6178 - DNA, 5513 bp, Homo sapiens
cggtcagcccgcgcgaggggtcggcgttcattcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaagggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacgagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcactgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcagggcttaagggcatctatcgatgcctatgacaactttgacaacatcagcctggctcagcagctggagaagcatcagctgatggagttcaggtgcattgcggcctatctgtacaagggcaataactggtgggcccagagcgtggagctctgcaagaaggatcatctctacaaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaa

SEQ ID NO: 6179 - DNA, 5313 bp, Homo sapiens
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaagggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacgagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcactgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaa

SEQ ID NO: 6180 - DNA, 5512 bp, Homo sapiens
accggtcagcccgcgcgaggggtcggcgttcattcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaagggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacgagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcactgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggtcggggaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcagggcttaagggcatctatcgatgcctatgacaactttgacaacatcagcctggctcagcagctggagaagcatcagctgatggagttcaggtgcattgcggcctatctgtacaagggcaataactggtgggcccagagcgtggagctctgcaagaaggatcatctctacaaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggc

SEQ ID NO: 6181 - DNA, 1152 bp, Homo sapiens
cctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 6182 - DNA, 1073 bp, Homo sapiens
gctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaact

SEQ ID NO: 6183 - DNA, 1090 bp, Homo sapiens
agtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgta

SEQ ID NO: 6184 - DNA, 1235 bp, Homo sapiens
gattggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagggtggcagatgaagctttctacaaacaacccttcgctgacgtgattggttatgtcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtatt

SEQ ID NO: 6185 - DNA, 1102 bp, Homo sapiens
gtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgt

SEQ ID NO: 6186 - DNA, 1181 bp, Homo sapiens
gattggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacagcacaaacataaaccatccttgctacagcctagaacaggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtatt

SEQ ID NO: 6187 - DNA, 989 bp, Homo sapiens
gattggttgttcccttttcggctctgcaacaccgcctagaccgaccggatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgccaattctcggaagcaagaagcagagtggaaagaaaaggcaataaaggagctagaagaatggtatgcaagacaggacgagcagctacagaaaacaaaagcaaacaacagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgtatt

SEQ ID NO: 6188 - DNA, 1215 bp, Homo sapiens
ccgctcctcccgccgcggcgcccgcaccgcagtgacagccagccgggcccggtggcggagaggaagtgcggtccgcgccaagcccgtccccgccgacgccggctcccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccggatcgctgacaaagcattctaccagcagccagatgctgatatcatcggctacgtggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagcca

SEQ ID NO: 6189 - DNA, 1161 bp, Homo sapiens
ccgctcctcccgccgcggcgcccgcaccgcagtgacagccagccgggcccggtggcggagaggaagtgcggtccgcgccaagcccgtccccgccgacgccggctcccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccgggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagcca

SEQ ID NO: 6190 - DNA, 1489 bp, Homo sapiens
agtgacagccagccgggcccggtggcggagaggaagtgcggtccgcgccaagcccgtccccgccgacgccggctcccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcagcccgtgcaccaccagcgggtccagctacaaacccagttgccaatacagcctaaggacgagcctgcccacaactattccagttccatttggcacagccaggggcagggacagaagggccctgcaggactccgcctccccacctctgcacagatcctctctcctttcccctaatactcccatcatcctccttttagcttcttagaggaatcagcagctcagcttagcttagatttagctgatcaatcccaaagaaggatgtggctcatcctcttggccatccctggagtcgcagcacacgcttggctggtgtgggtccacagaggttctcatgggtgggcccagcagaggggcccctcaggagagggattctagggagctagactgagacaagcctggccctgactgtcgcctcctgccttctggtcctggccattcctgcccctttctctctccagagcttgggaggagtcagaacattgctctagccgctggtgatctctcctggttgccaaccctcctggccatgactgatctccccactgagatgctcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccgggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctc

SEQ ID NO: 6191 - DNA, 3481 bp, Homo sapiens
ctttaaatcgcggcgcccagcggttctgcgtctcagttcccgagcctgggagcaaccgcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaactgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtctatatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcattggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaacaaaaaaaatgttaagaaatgggtttcttgccttaaccagtctctcaagtgatgagacagtgaagtaaaattgagtgcactaaacaaataagattctgaggaagtcttatcttctgcagtgagtatggcccgatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccactgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataataggaatttgtataaagcattactctttttcaataaattgttttttaatttaaaaaaaggatta

SEQ ID NO: 6192 - DNA, 1452 bp, Homo sapiens
tcagttcccgagcctgggagcaaccgcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaactgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtctatatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacatttt

SEQ ID NO: 6193 - DNA, 2169 bp, Homo sapiens
agcagcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataagagggctgcccggctgcccacagaggtgctgtagatgctgggcccagggccctaggtttgctcgtcacagtgtggggaagcccattcctctgccaggctctaaagccaaaggtctagaaaagcatcctgtctggcattttgtagtcttaacttctccccatttcccccatcttttggttgccttaaaagaaatctctagctcagataatgcccagacatttttttcccttggtgttgcccctattagctcttttcttgggcattcttttgctgtttattaaaaatatattatatatattttgtttctttaaatttcaaatgttttgcaaacatcactgagttaggtgggggtggggaagagaaatacaagatacttttttttttttttttttttttttttttttaaatagggcctcactctgttgctcaggctggagtgcggtggtgtgatctcggctcatgtagcctcaacctccccggctcaagtgatcctcctgcctcagcctcccaagtagctgggactacaggcgttcactactacacccagctaatttttaagttttttatagagatgagggctccctatgttgcccaggttggtctcgaactcctggactcaaagtatcctcccgcctcggcctcccaaagtgttgggattataggagtgagccaccacaccggccaagatgcttttcaaactgatacagatgacaatgggagcctcataaagatggcttttgtttcttcccttcaaggtcatttacttgtacgagacagaaaaagatagcattggggacatgggatgggggagggagggcaatagtggaacgaactttccatgggaaactttcccttttgtaagttgagggccaggggtagggatattttttagtttgtgattttacatttatctgtacatactttttcaagattgatcatttttataaccatggttttcctgaaatcctcaattcatcaatatgaaggaaatgaaccacatagactttatgcaataaataacagtgcaagtgagtataactctaactgatgttccacaaaacatttttgatttcaggtttgtatgatgtagtttttaatcgtacattttcatatgcttcaaactaacacatttttaaagctttcccccacttttctctctatttgtattgttagccatcttgaagtgatgttgtttaacataaattgtactgttgaatttggctttacgggtgtaaacactgatggtatatcagtatctgagaccccaaactctccaaatactgatggtgcattttattcttgaagtgaaatctgtgcaataaaataacagactgtctgcaaaa

SEQ ID NO: 6194 - DNA, 498 bp, Homo sapiens
atggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctgggctgtcagcttctttgggcaaagactgagtcatctctgcattctcagcacctggtgcaatttaagcagaaatatcttgaagatttttcgtatcttcagggagattag

SEQ ID NO: 6195 - DNA, 1139 bp, Homo sapiens
agcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctgggctgtcagcttctttgggcaaagactgagtcatctctgcattctcagcacctggtgcaatttaagcagaaatatcttgaagatttttcgtatcttcagggagattaggaatgggaatggaatgggaacgccaatgcaggaaggatgagaagtctgcagatgcctccaaggagtccgaaaccaagtccgaagtcaacgacaagcaatgatggcgatggcgatcctagttaataaaaaggggggagatgtgggctgcaagccacccaggtgccgaggcaagagaccgaggacatgagctgttccagtataataaaatataaaacaagaatagttataccagatatagatcttagatatgattatatatgaatataattaatcattagtttgtggcaattactctttattccaatattataataatcctcgctctataatcataacctaggaaaaaccaggccatacagagataggagctgaggggacatagtgaggagtgaccagaagacaagagtgcgagccttctgttatgcccagacagggccaccag

SEQ ID NO: 6196 - DNA, 1453 bp, Homo sapiens
ggggagggcaagctgggaaaagctgagagaggcaggcagcccagccaggcagaagtcacgagccaggcacctgccaagagagggagtaagatgttcaagaggagctccggaagaactttcagatatagcactggacttggctgaggacacagcagcacggggctgcaaggcccagagatctggacacaagccaagaagtcaagaactgttgaagccgcagtctccactctcctactgacaccagagaccacccagcccagccaaaccatatggcctcttgttttcctgatgtatgagggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaa

SEQ ID NO: 6197 - DNA, 1752 bp, Homo sapiens
cgccaggtggtggctcagaggaggacacagtcgctgtgggcaggtggtcagggcgcaggagggaatgagctgtggatttttagtaatctacaacaatcaggcagttccaggacacagggaagtgagtgtgaacagccaatggacccggagccgagagcctgggcaggcgtaggctggactatggacgccctgcaaccctgccaggctgggaaggggaggcttgatcctgagcgcgtgttaggaaggagatgcccaggttcaggtgtatcgtgcattttttttccacagtgcagaaatgacatttctggttggtcttgaatgtctgctctggccaagccacctcctctcatgctagctaaccaagtggcacgtgtgcccacgcaggccattctaaggaacactgtaattgtctagacaattttctctcaaatactccgtcctggaagcgtctggttggcagaagagggaaggcaggagggtggcagcgtcccggctgagtcctcttgcacatgggagctggagtccagccaggctccagagcggctccggctggcaagggacctgaacaggaagatgagactcgaggttttctgcatggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaa

SEQ ID NO: 6198 - DNA, 1330 bp, Homo sapiens
agcggccatgagctggtgtgcagccgcccaggaggggggctgcaaggcccagagatctggacacaagccaagaagtcaagaactgttgaagccgcagtctccactctcctactgacaccagagaccacccagcccagccaaaccatatggcctcttgttttcctgatgtatgagggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaa

SEQ ID NO: 6199 - DNA, 1942 bp, Homo sapiens
cgccaggtggtggctcagaggaggacacagtcgctgtgggcaggtggtcagggcgcaggagggaatgagctgtggatttttagtaatctacaacaatcaggcagttccaggacacagggaagtgagtgtgaacagccaatggacccggagccgagagcctgggcaggcgtaggctggactatggacgccctgcaaccctgccaggctgggaaggggaggcttgatcctgagcgcgtgttaggaaggagatgcccaggttcaggtgtatcgtgcattttttttccacagtgcagaaatgacatttctggttggtcttgaatgtctgctctggccaagccacctcctctcatgctagctaaccaagtggcacgtgtgcccacgcaggccattctaaggaacactgtaattgtctagacaattttctctcaaatactccgtcctggaagcgtctggttggcagaagagggaaggcaggagggtggcagcgtcccggctgagtcctcttgcacatgggagctggagtccagccaggctccagagcggctccggctggcaagggacctgaacaggaagatgagactcgaggttttctgcatgcctggaagtgcacatgctcatctacagctttcttggaagaagaaagaaacaaaaactgagatttagaacaccaggtctgtttccactggcggccactcttgggcactggagaccagcaagagctttgtttttaaaaggctcttccatggcagatattcgcagaggcatcagggctacacttaaatgaagggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaa

SEQ ID NO: 6200 - DNA, 1231 bp, Homo sapiens
tgtaaagaggatgtgtttgcttcaccttctgccaggattgtaagtttcctgaggcctccccagtcctgcggaactggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaa

SEQ ID NO: 6201 - DNA, 3273 bp, Homo sapiens
cttcttccgagtggggaggagaatagctcactctccctagagggcctaagaaagatcagtttacaggttccagcatggggtgggacccttcctccttcccccgtcttggcactggcacttggtctggtgaccaccactagcccacagttgggtcagaaaacgttacagaactcctctctcccccacccgaaacacactcagcccttgcactgacctgccttctgattggaggctggttgcttcggataatgacctccaggaccccactgttggttacagcctgtttgtattattcttactgcaactcaagacacctgcagcagggcgtgagaaaaagtaaaagaccagtattttcacattgccaggtaccagaaacacagaagactgacacccgccacttaagtggggccagggctggtgtctgcccatgttgccatcctgatgggctgcttgccacaatgagggatcttcttcaatacatcgcttgcttctttgcctttttctctgctgggtttttgattgtggccacctggactgactgttggatggtgaatgctgatgactctctggaggtgagcacaaaatgccgaggcctctggtgggaatgcgtcacaaatgcttttgatgggattcgcacctgtgatgagtacgattccatacttgcggagcatcccttgaagctggtggtaactcgagcgttgatgattactgcagatattctagctgggtttggatttctcaccctgctccttggtcttgactgcgtgaaattcctccctgatgagccgtacattaaagtccgcatctgctttgttgctggagccacgttactaatagcaggtaccccaggaatcattggctctgtgtggtatgctgttgatgtgtatgtggaacgttctactttggttttgcacaatatatttcttggtatccaatataaatttggttggtcctgttggctcggaatggctgggtctctgggttgctttttggctggagctgttctcacctgctgcttatatctttttaaagatgttggacctgagagaaactatccttattccttgaggaaagcctattcagccgcgggtgtttccatggccaagtcatactcagcccctcgcacagagacggccaaaatgtatgctgtagacacaagggtgtaaaatgcacgtttcagggtgtgtttgcatatgatttaatcaatcagtatggttacattgataaaatagtaagtcaatccaggaacagttatttagaattcatattgaattaaattaattgctagcttaatcaaaatgtttgattctcctatactttttctttctattactcttatattttcccgtcattctctctgctaaccttccaccttatgcacacactttccctatattttaagataagtctgctaggatgtagaaatatttgtttgtgatttctatatagctattagagattatgacatagtaatattaaaatgaaatgatacttaaacagaaagcaatttccaaagaggccagggaccctaatctttgaagagatgaagaaacttacttttctccctggcttttggttcactttttgtacttttaacaagtgggtgaattatttgataattttgaggaagattattcttttaaattcaaactagtatgtcaatgcctaccattactctgattatattaaaacagaaaaaggaaataacaacttcgtataccagccactggtgagagttaaagacaagagctgcccccccacccccaaatgtcaaaggcaaatgctaaattgatactggagctcgtggtgactttctacctcactaacaacataagggatctccatattatttcaccactattctagctttgctgatatattgccaaatgattagactacagaatagttcaaccagagaatttactcatttattgattaaacatccaaatactattgtaatatactatgttaaaattcatcaattcaagtgcccacacaccactgaatcatcagcaccaagcaatatattagacatatggcaaaattcaacaaatatattttgatataaataaataaacgttcacgactttacttaaaaaatcaatgttgcggctgggcacggtagctcgcgtctgtaatccccgcactttgggaggccaaggcgggtggatcacgaggtcaagagacggagaccatcctggctaacatggtgaaaccctgtctctactaaaaatacaaaaattagccgggcgtggtggcggtgcctgtagtcccagctactcgggaggctgaggcaggagaatcgtttgaacccaggaggtggaggttgcagtgagcggagatcgcaccattgcactccagtctggcaacagagcgagactccatctcaaaaaacaaaaataaataaataaataaatattcttcataaaatgtgggttttggggaaaatatagaattacatatacatttaacgaagtcgctaatgacatttcattcatattcataatgtaaccatcttgaatttttttaattgtagcgattttaaaaatgtttgtaaaatttaatttccagttttctaattacttgtcagtcacattaataacattagtacctttatggtacccttgcagtacctgaaaagaatatcaacctgaaaagaatatcaactcacccagaaattagttctttgaaaaaaaagaaattaagttgtgaatttctaaagaccttgaaataagtgtttcaaatttaaagaacaaagaatgatgtgaaaatgagattatgattcctactacatgaattaacgtttcgagattgctgtttattacttcccagagtatctttaacagtattctctgaagcagttccaatctagttggagaattaacagcaattgatttaactatctcatttttattaactgtaatttactttaaaaatatttgcaaatcatactcattagttatttgatcattgttctatgcattttaaaattaattttgtgttgttcctctcaatatttgtttttaacatttattcccatttttattttatactattgtctgtcatgctttatgtattccaataagtgtcttgaaatccttgtggggaaaggcaggacaaaaataattagttaattagatttgaaaaatgtaatttttccattttaaatatttcatttgtataagaaaatatttcagagaaccatgatgataatggatatgtgtgactgttttgaatttttttctcaattaaaacattttgtatgtaatggga

SEQ ID NO: 6202 - DNA, 430 bp, Homo sapiens
atgacctccaggaccccactgttggttacagcctgtttgtattattcttactgcaactcaagacacctgcagcagggcgtgagaaaaagtaaaagaccagtattttcacattgccaggtaccagaaacacagaagactgacacccgccacttaagtggggccagggctggtgtctgcccatgttgccatcctgatgggctgcttgccacaatgagggatcttcttcaatacatcgcttgcttctttgcctttttctctgctgggtttttgattgtggccacctggactgactgttggatggtgaatgctgatgactctctggagatgttggacctgagagaaactatccttattccttgaggaaagcctattcagccgcgggtgtttccatggccaagtcatactcagcccctcgcacagagacggccaa

SEQ ID NO: 6203 - DNA, 2859 bp, Homo sapiens
attctggagtccagagccactgcctttgctccagccgctgccgccgcaccacctctccttctctgcctctgaccctccttctcgctgctccccctgcccagctgctcctcccacctggccatgaccaaagcccctgctggcaccctggcccagctctgagtcctgggaccctcggtcctctctcctgggccatggccaactcaggcctccagctcctgggctacttcttggccctgggtggctgggtgggcatcattgctagcacagccctgccacagtggaagcagtcttcctacgcaggcgacgccatcatcactgccgtgggcctctatgaagggctctggatgtcctgcgcctcccagagcactgggcaagtgcagtgcaagctctacgactcgctgctcgccctggacggtcacatccaatcagcgcgggccctgatggtggtggccgtgctcctgggcttcgtggccatggtcctcagcgtagttggcatgaagtgtacgcgggtgggagacagcaaccccattgccaagggccgtgttgccatcgccgggggagccctcttcatcctggcaggcctctgcactttgactgctgtctcgtggtatgccaccctggtgacccaggagttcttcaacccaagcacacctgtcaatgccaggtatgaatttggcccagccctgttcgtgggctgggcctcagctggcctggccgtgctgggcggctccttcctctgctgcacatgcccggagccagagagacccaacagcagcccacagccctatcggcctggaccctctgctgctgcccgagaaccagttgttaaattgcccgcctccgccaagggccccctgggtgtgtaatgtccagtccccagccaggctctgtcccctgccatacctagactgtgtgtttcatatttttttggaaagagaagtgaacatccagccccaatcatggtatcattcggtctgtcctcagcgtggcttggacggggcctgtgtcagagtggtcagtgctgacccctggggctcttgggcagaaagatgaggagacagaggtccagggtgggttacatagcacatccagggctaagcaagaaataattcagaggtcctaccctctgtctagggacccccctcccaagcctggccttggccttggcacaaagtcctccttgataggagatcccactcactcctggaggctgcccctgaggcttggcccagctctaggagcagtccccagggtcagggagcccctggtgtggaaagaggccccaaggtagtaaaccctgcccctgttactgtgctccagagacctcctaagggaagggacagttcctggaaggccctccagctggatgctggggatcagcgataggtgaggggacacagtgtaggagctccccatgtagaaaagggaatgtggggagggcgttaggagcttgcaggcattaggactgtcctgagcaaggtctgcagcccccagctctgctcaccccgaatcctgccccttgtttccacacctaccattcctcctctcctgatccccagcatccagctgaggtccaaggtctttgtcctagaatcagagtggggaggggacagcctggggctgcccagagactgtgggtggagctgcctgctgcactcagcagtgcggtcagagaagggcttttggtcttgaagtccaggtaccatccccccttagcatacagggggaagggcctgagaggaatgtaaggaaaccagcccagatcagtcccaaggccagagtcctttgtcctacatctccctgaaccagagtgtgccctgcccctcatgctcagacctctcccaccccaaaccctctcccgggactcagtctccctggccactgcgtatcaggcttctggggaaagcatccatcacagaacctccccttccctgccacgcaccttccttggccagctccattctggcctcctccaccacctgccttgtgaccacatctcccaccacgtccccagatctcaagaacgcagctcagcttctccttcgagcttgactctgagagggaaagtgacggaaaccaagtcagatgagatgactgccatgtacactgcagtcaagggcagggaggggaggaatgacacaaatggcagggagctgctgggggactgacccctcggcgcctggcctggccggtgctgcacatccaccggggcacaacagggacttgtccagcctctggtcagaggatgtggccacctgaccctaaataggttccccagagtcctgcccctctaatgaatgagaactgcaggagtttctcctctgggtgcctgaagctatagtgcaatggttcccaaccctgcatgcacattcgaatcacctgggggcacaatgcctaggctccaaccccagacactcttatttcattggtctgggtggacctggcatcagaagtcatgtagctcctcaggggactgtagtgtgtggtcagcactgagggctcctctatgaggcctcaagcccaggtgactctgtgaggtctgcagagggagaaaagaacccacaagggaagaggtggaggtcaggcacggtggctcacgcttgtaatcccagcactttgggaggccgaggtgggtagatacctgaagtcaggagttcgagactagcctggccaatatggtaaaaccccgtgtctattaaaaatacaaaaattagctggctgtggtggtgggcacctgtaatcccagctactcgggaggctgaggcaggagaatcgcttgaactcgggaggtggaggttgcagtcagccaagatcgtgccactgcacaccatcctggatgacagagcaagactccatcac

SEQ ID NO: 6204 - DNA, 1586 bp, Homo sapiens
ctggccatgaccaaagcccctgctggcaccctggcccagctctgagtcctgggaccctcggtcctctctcctgggccatggccaactcaggcctccagctcctgggctacttcttggccctgggtggctgggtgggcatcattgctagcacagccctgccacagtggaagcagtcttcctacgcaggcgacgccatcatcactgccgtgggcctctatgaagggctctggatgtcctgcgcctcccagagcactgggcaagtgcagtgcaagctctacgactcgctgctcgccctggacggtcacatccaatcagcgcgggccctgatggtggtggccgtgctcctgggcttcgtggccatggtcctcagcgtagttggcatgaagtgtacgcgggtgggagacagcaaccccattgccaagggccgtgttgccatcgccgggggagccctcttcatcctggcaggcctctgcactttgactgctgtctcgtggtatgccaccctggtgacccaggagttcttcaacccaagcacacctgtcaatgccaggtatgaatttggcccagccctgttcgtgggctgggcctcagctggcctggccgtgctgggcggctccttcctctgctgcacatgcccggagccagagagacccaacagcagcccacagccctatcggcctggaccctctgctgctgcccgagagtacgtctgagctccgcctgccctggccagccccccacccagtggcccccttgcccagcatccagccagcctcgcagcaccctgggcagggccactggggcataggatgggcataggtgctctgagcagcttgtcctcaacacaagcacccaccctgcaatctgagacccagatcctcagagagacaccagaggcaggacccagcccccaggcatacacacagatgcaggtccaggcacggtcttgtctgcacagcctggtgggcaccagcatgcatccctggagacaggccctcaggcaccagcccggctgtttactcactgaagagctgcttgggtgtctgctacgtgctgggccctagagatagagcagtggccaagacgtaccttagtacccaggtccttggggtgagcagaaaccttcaccctccccagtcccatgggctcctcacagcaaccccacaagggcagtgccgggatgctgaacgttcacacaaggacagggagggtctgagtttaggtctcaggttcttccagtgcgcccagggctgggggccacctacacagatggtgaggtcggaccatggcgcccctgcccccgggaatgggccccaggcagggctgctgtgagggccaaggtctggccacgctggccagtacccatgtccgggcctgaatgcacagcccctgcccccgaccccacagctcactccactaaccagctctctctcttttgactttcagaccagttgttaaattgcccgcctccgccaagggccccctgggtgtgtaatgtccagtccccagccaggctctgtcccctgccatacctagactgtgtgtttcatatttttttggaaagagaagtgaacatccagccccaa

SEQ ID NO: 6205 - DNA, 3517 bp, Homo sapiens
attctggagtccagagccactgcctttgctccagccgctgccgccgcaccacctctccttctctgcctctgaccctccttctcgctgctccccctgcccagctgctcctcccacctggccatgaccaaagcccctgctggcaccctggcccagctctgagtcctgggaccctcggtcctctctcctgggccatggccaactcaggcctccagctcctgggctacttcttggccctgggtggctgggtgggcatcattgctagcacagccctgccacagtggaagcagtcttcctacgcaggcgacgccatcatcactgccgtgggcctctatgaagggctctggatgtcctgcgcctcccagagcactgggcaagtgcagtgcaagctctacgactcgctgctcgccctggacggtcacatccaatcagcgcgggccctgatggtggtggccgtgctcctgggcttcgtggccatggtcctcagcgtagttggcatgaagtgtacgcgggtgggagacagcaaccccattgccaagggccgtgttgccatcgccgggggagccctcttcatcctggcaggtatgaatttggcccagccctgttcgtgggctgggcctcagctggcctggccgtgctgggcggctccttcctctgctgcacatgcccggagccagagagacccaacagcagcccacagccctatcggcctggaccctctgctgctgcccgagagtacgtctgagctccgcctgccctggccagccccccacccagtggcccccttgcccagcatccagccagcctcgcagcaccctgggcagggccactggggcataggatgggcataggtgctctgagcagcttgtcctcaacacaagcacccaccctgcaatctgagacccagatcctcagagagacaccagaggcaggacccagcccccaggcatacacacagatgcaggtccaggcacggtcttgtctgcacagcctggtgggcaccagcatgcatccctggagacaggccctcaggcaccagcccggctgtttactcactgaagagctgcttgggtgtctgctacgtgctgggccctagagatagagcagtggccaagacgtaccttagtacccaggtccttggggtgagcagaaaccttcaccctccccagtcccatgggctcctcacagcaaccccacaagggcagtgccgggatgctgaacgttcacacaaggacagggagggtctgagtttaggtctcaggttcttccagtgcgcccagggctgggggccacctacacagatggtgaggtcggaccatggcgcccctgcccccgggaatgggccccaggcagggctgctgtgagggccaaggtctggccacgctggccagtacccatgtccgggcctgaatgcacagcccctgcccccgaccccacagctcactccactaaccagctctctctcttttgactttcagaccagttgttaaattgcccgcctccgccaagggccccctgggtgtgtaatgtccagtccccagccaggctctgtcccctgccatacctagactgtgtgtttcatatttttttggaaagagaagtgaacatccagccccaatcatggtatcattcggtctgtcctcagcgtggcttggacggggcctgtgtcagagtggtcagtgctgacccctggggctcttgggcagaaagatgaggagacagaggtccagggtgggttacatagcacatccagggctaagcaagaaataattcagaggtcctaccctctgtctagggacccccctcccaagcctggccttggccttggcacaaagtcctccttgataggagatcccactcactcctggaggctgcccctgaggcttggcccagctctaggagcagtccccagggtcagggagcccctggtgtggaaagaggccccaaggtagtaaaccctgcccctgttactgtgctccagagacctcctaagggaagggacagttcctggaaggccctccagctggatgctggggatcagcgataggtgaggggacacagtgtaggagctccccatgtagaaaagggaatgtggggagggcgttaggagcttgcaggcattaggactgtcctgagcaaggtctgcagcccccagctctgctcaccccgaatcctgccccttgtttccacacctaccattcctcctctcctgatccccagcatccagctgaggtccaaggtctttgtcctagaatcagagtggggaggggacagcctggggctgcccagagactgtgggtggagctgcctgctgcactcagcagtgcggtcagagaagggcttttggtcttgaagtccaggtaccatccccccttagcatacagggggaagggcctgagaggaatgtaaggaaaccagcccagatcagtcccaaggccagagtcctttgtcctacatctccctgaaccagagtgtgccctgcccctcatgctcagacctctcccaccccaaaccctctcccgggactcagtctccctggccactgcgtatcaggcttctggggaaagcatccatcacagaacctccccttccctgccacgcaccttccttggccagctccattctggcctcctccaccacctgccttgtgaccacatctcccaccacgtccccagatctcaagaacgcagctcagcttctccttcgagcttgactctgagagggaaagtgacggaaaccaagtcagatgagatgactgccatgtacactgcagtcaagggcagggaggggaggaatgacacaaatggcagggagctgctgggggactgacccctcggcgcctggcctggccggtgctgcacatccaccggggcacaacagggacttgtccagcctctggtcagaggatgtggccacctgaccctaaataggttccccagagtcctgcccctctaatgaatgagaactgcaggagtttctcctctgggtgcctgaagctatagtgcaatggttcccaaccctgcatgcacattcgaatcacctgggggcacaatgcctaggctccaaccccagacactcttatttcattggtctgggtggacctggcatcagaagtcatgtagctcctcaggggactgtagtgtgtggtcagcactgagggctcctctatgaggcctcaagcccaggtgactctgtgaggtctgcagagggagaaaagaacccacaagggaagaggtggaggtcaggcacggtggctcacgcttgtaatcccagcactttgggaggccgaggtgggtagatacctgaagtcaggagttcgagactagcctggccaatatggtaaaaccccgtgtctattaaaaatacaaaaattagctggctgtggtggtgggcacctgtaatcccagctactcgggaggctgaggcaggagaatcgcttgaactcgggaggtggaggttgcagtcagccaagatcgtgccactgcacaccatcctggatgacagagcaagactccatcac

SEQ ID NO: 6206 - DNA, 1273 bp, Homo sapiens
agcccagtcgccgccgcccgcccacaaagccacaggcaggtgcaggcgcagccgcggcgagagcgtatggagccgagccgttagcgcgcgccgtcggtgagtcagtccgtccgtccgtccgtccgtcggggcgccgcagctcccgccaggcccagcggccccggcccctcgtctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgcagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcccagtgcaccaactgcgtgcaggacgacacggccaaggccaagatcaccatcgtggcaggcgtgctgttccttctcgccgccctgctcaccctcgtgccggtgtcctggtcggccaacaccattatccgggacttctacaaccccgtggtgcccgaggcgcagaagcgcgagatgggcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcaaggactacgtctaagggacagacgcagggagaccccaccaccaccaccaccaccaacaccaccaccaccaccgcgagctggagcgcgcaccaggccatccagcgtgcagccttgcctcggaggccagcccacccccagaagccaggaagcccccgcgctggactggggcagcttccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgctcgcgctgggcagggaccggcagccctggaaggggcacttgatatttttcaataaaagcctttcgttttgc

SEQ ID NO: 6207 - DNA, 1822 bp, Homo sapiens
aaaagtgcctttgttggcctgggctcaggaatccagagaaactggtcaggaggaggccccagtgacaaaaacccctccctctgcccccgcccctctgccagagccatataactgctcaacctgtccccgagagagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacagg

SEQ ID NO: 6208 - DNA, 4108 bp, Homo sapiens
aaggctacctggctgggaccacagatggagtctcgctctatcacccaggctggagtgcaatggcgcgatcttggctcaccgcaacctccatctcccaggttaaagcgattctcctgcctcagtctcctgagtagctgtgattacaggcgtgcgccatcacacccagctaatttttgtattttttagtagagatggggtttcaccatgttggcctaactcctgacctcgtgatctgcccatcttggcctccgaaagtactgggattacaggtgtgagccactgcacccggcccaaacatttctttttcttttcttttgagacagagtcttgctctgttgcccgtggctggagtgaaatggtgcgattatagttcactgcagcctcaaactcctggccttaagcgatcctcccatcctggcctcccaaagtgctgggattataggcatgagccgcagcaaccactcctcacatttcttgagcatctgtgatgtatcaagccagatgctgggcactgaggttgcagaaggcattgttcctgtcttctaggagccccaggctagcagggaagacggatgtgtatagagttaaccacaataccaggcctcaacttcccgtctgtaacacaggtggaccatgctagattgtcccagcctgccctgtgcttcattagccggtcaacagatccatctcaaatacctcccatgggtactcactgattgctttaacccaaaccatggcactcttgaagactttccctcaggaagctcaaggactatgcatccttctgggtcagaactggacacacagccaccagtgctggacaatggcggcggctcagggacacactggagccctggcccctgcagagctcccagcatggttgggaagagagatgcaaaatgaccacacggcgggtgaggaggagctccctcggtgcggctgggatgagccctagacactctcaatcacccccacgatgaccccttcccagaggtcccctcagtcatctgccctgaaccaagctcttcctgatcctagaccctccaccctccctctatcttccagggcttggtgacattccaggcagaaatttctgacccttttactttggtccctccctccccagcccagtctctggtcaaactggattcctggctgttcccagaacgagctgcctttccccaccttgccacctctgcccttgttctctctgcctgaatgtcctccttcactagcctcgctgccttgcacatctctcctgagggctgtcatcccagaatgagctgcatttgtccagcctggcccaccgtctaccagaacgtcctccttcagcctgtcccactgccttgcaaaacttttctgggggacctgttcacgatgccttctgtagcatactccaagaatccggcgccccctggagttgtgccacacagcacccctttgcagtcaagctccctcagcaccaccacctccaccctggaagagttccccttccctttgaaatctcatgggactttgcacccactctggctttattggaaggctttgtatgtctccacagggtaaacacccatttactggggtgatgatgtctccaggatctagttcatgtttgtcgttggtgactggccccacccagttctgggcaagcaggctggatcccggcaggaacagagcccaccagcctaaacttccatggaggtggagaggggacaggcttctgtctctttttggctgaaggtgcatcatgtccaaggcccctcttctagccaagcagagaagctgggtgataaggatgggtgagagtgggtgatgtaccccggagtcctggcctcccggctcctcactcccctacacgtaactttatccggccaatgccgcaaagactgctggtgaggccagatgcatgagtgatcatactcacaacagtcgtgaaactgccagtgatgaaactggtaaggacaagaaatgacaataatcaaggtggggtttctcgtggacgtttccaagacttcattctcaaattctctccctcagggtccccaccctgtcctcccacctaagcctggaatgagggggcactggcctgtggggaccctggtcttcaggctcccaaacctggctgggtctggttgccccctggccttaacctgtgaacatccagctgtccctgggctgtgattcagtgtctgtctcccgggtgacctcagcatgggctttgaggaaggggagagagtagtttcttctgagactggatagtgactcagggacccggggctggggcctcaaaagtgcctttgttggcctgggctcaggaatccagagaaactggtcaggaggaggccccagtgacaaaaacccctccctctgcccccgcccctctgccagagccatataactgctcaacctgtccccgagagagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacag

SEQ ID NO: 6209 - DNA, 4163 bp, Homo sapiens
cacttgtgctgagctactggctgatccccaaggacatccttctggcctctccttcacacctgggtcccctagccctgcatggagtctcgctctatcacccaggctggagtgcaatggcgcgatcttggctcaccgcaacctccatctcccaggttaaagcgattctcctgcctcagtctcctgagtagctgtgattacaggcgtgcgccatcacacccagctaatttttgtattttttagtagagatggggtttcaccatgttggcctaactcctgacctcgtgatctgcccatcttggcctccgaaagtactgggattacaggtgtgagccactgcacccggcccaaacatttctttttcttttcttttgagacagagtcttgctctgttgcccgtggctggagtgaaatggtgcgattatagttcactgcagcctcaaactcctggccttaagcgatcctcccatcctggcctcccaaagtgctgggattataggcatgagccgcagcaaccactcctcacatttcttgagcatctgtgatgtatcaagccagatgctgggcactgaggttgcagaaggcattgttcctgtcttctaggagccccaggctagcagggaagacggatgtgtatagagttaaccacaataccaggcctcaacttcccgtctgtaacacaggtggaccatgctagattgtcccagcctgccctgtgcttcattagccggtcaacagatccatctcaaatacctcccatgggtactcactgattgctttaacccaaaccatggcactcttgaagactttccctcaggaagctcaaggactatgcatccttctgggtcagaactggacacacagccaccagtgctggacaatggcggcggctcagggacacactggagccctggcccctgcagagctcccagcatggttgggaagagagatgcaaaatgaccacacggcgggtgaggaggagctccctcggtgcggctgggatgagccctagacactctcaatcacccccacgatgaccccttcccagaggtcccctcagtcatctgccctgaaccaagctcttcctgatcctagaccctccaccctccctctatcttccagggcttggtgacattccaggcagaaatttctgacccttttactttggtccctccctccccagcccagtctctggtcaaactggattcctggctgttcccagaacgagctgcctttccccaccttgccacctctgcccttgttctctctgcctgaatgtcctccttcactagcctcgctgccttgcacatctctcctgagggctgtcatcccagaatgagctgcatttgtccagcctggcccaccgtctaccagaacgtcctccttcagcctgtcccactgccttgcaaaacttttctgggggacctgttcacgatgccttctgtagcatactccaagaatccggcgccccctggagttgtgccacacagcacccctttgcagtcaagctccctcagcaccaccacctccaccctggaagagttccccttccctttgaaatctcatgggactttgcacccactctggctttattggaaggctttgtatgtctccacagggtaaacacccatttactggggtgatgatgtctccaggatctagttcatgtttgtcgttggtgactggccccacccagttctgggcaagcaggctggatcccggcaggaacagagcccaccagcctaaacttccatggaggtggagaggggacaggcttctgtctctttttggctgaaggtgcatcatgtccaaggcccctcttctagccaagcagagaagctgggtgataaggatgggtgagagtgggtgatgtaccccggagtcctggcctcccggctcctcactcccctacacgtaactttatccggccaatgccgcaaagactgctggtgaggccagatgcatgagtgatcatactcacaacagtcgtgaaactgccagtgatgaaactggtaaggacaagaaatgacaataatcaaggtggggtttctcgtggacgtttccaagacttcattctcaaattctctccctcagggtccccaccctgtcctcccacctaagcctggaatgagggggcactggcctgtggggaccctggtcttcaggctcccaaacctggctgggtctggttgccccctggccttaacctgtgaacatccagctgtccctgggctgtgattcagtgtctgtctcccgggtgacctcagcatgggctttgaggaaggggagagagtagtttcttctgagactggatagtgactcagggacccggggctggggcctcaaaagtgcctttgttggcctgggctcaggaatccagagaaactggtcaggaggaggccccagtgacaaaaacccctccctctgcccccgcccctctgccagagccatataactgctcaacctgtccccgagagagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacagg

SEQ ID NO: 6210 - DNA, 1650 bp, Homo sapiens
gtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggagg

SEQ ID NO: 6211 - DNA, 2357 bp, Homo sapiens
atcgccactggtgggagggcagggcacagcccctccgtgtccctttgtctctcctgtctgaaggccagagcaggctgctaggcctggggccaccactgcccctgggtgctacacccagtgtgctgggtcactgggaacttcctgaagtggtgtcacctgaactgggcccccaaggatggggtgcgggcagtaccgcaggaagaggagcagcccctgtgaagattgagaggtctgggaagcccctgcggcttgggagagtgggggtcgccaggcagggggaaagcccctgtgccaccgctttttgccagagactcaggctccagagaggcagtgagtggcatggggggtgaggctggggccctgggcctgacctccacacgcctgcctggcctctctgtttgccatgggatgagagagacagtgctgggactcagagcggggctggagagtgagagtgcgagaaagggcctgggtggggcttggaccccggggcgggctttctggagagcccccctacgagggcctctacggcggtgacggggtggggggcttctgcaaaccttggtcagggaagtggagctggctcgagtggaagagaccacccggctcagtcggggatgtgggagtggactgggtggtgcagactgggggtcgagcgccttctgaagtgacggggccgggacgcgcagggaggcggcccaagaagcgcgccctaggccagcccagaatgcgctcggccgcgactaggacaacggcgggtggggctgggggcggctgccgggcggggagcggtcccgcgccctcagctacccctcaagagccgttgtttccctaacttcagctgccagaggctctgtgattggctgcggcacgatgacccgcgcacggattggctgcttcgggccggggggccgggcccgggggacagaatccgcccccgaaccttcaaagagggtaccccccggcaggagctggcagacccaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctc

SEQ ID NO: 6212 - DNA, 2548 bp, Homo sapiens
aaagcagaacaatggctgggggtgagcaggtggccttggccagtgctctgccccaagggccctttaccagagatcaggggtttgtgtccctgcctaaccaggacacctccgatctccacctgcaggccctggaccactgtggcactgtggacacaaggccgcttctgccccttggacgccgagccccttcccacctctgggatcttgcactggctattgcttctgctctgcctggaacttcttccccggatccctgtgaaatgtcacctcttcagagaggccttcaccactgtctttcctgcccagttcttggttgataggttcctgtcagctccttctgggcaggagcttcttgtgctgtgtgctctgcctagagacagtgcttgccacgaagtaggtgagcagaccctccatgagtggcaggaaaggtgggtgcaccctcatgcccctccggagtctggcctgggctactcagaggccagcctccatctgaggtgggtttgtctggggtggcgtcagcccctgcggccctctctgggcctctctgcattggcattgttccactgcagcctggggcctcgaccaacatagtggggtcagggtagaaaccagattgtgaaaggtgaagcctgagactcctctgccacgtccctgagatgctgtgaggctgccgccaaagaaacatgagcttgctggggccaccctagggtgacagctaggagagaagaaaaacaggcagccaggtgagaagggagagccttgggctggctgcagctccaagctggctagagggcaacaggcagcctcctgtgcaggacagacgcatgaagacagccaccctgtggaggttattcctggatactaggtgggaaagtcggcaagcaaaaggacaggtccagctcaagcttctaaaagcaatgctgggggacggtgcagcaaggtgttcctggaaatgacctcggcaacacatcttagaagatgagcaggacccaacctgacagatacacgctgcgggcagaagaggccaagctgccagaggctctgtgattggctgcggcacgatgacccgcgcacggattggctgcttcgggccggggggccgggcccgggggacagaatccgcccccgaaccttcaaagagggtaccccccggcaggagctggcagacccaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctctcc

SEQ ID NO: 6213 - DNA, 1760 bp, Homo sapiens
ttccggagggtggcctgggggctggggtgccagggacaccatcgccactggtgggagggcagggcacagcccctccgtgtccctttgtctctcctgtctgaaggccagagcaggctgctaggcctggggccaccactgcccctgggtgctacacccagtgtgctgggtcactgggaacttcctgaagtggtgtcacctgaactgggcccccaaggatggggtgcgggcagtaccgcaggaagaggagcagcccctgtgaagattgagagctgccagaggctctgtgattggctgcggcacgatgacccgcgcacggattggctgcttcgggccggggggccgggcccgggggacagaatccgcccccgaaccttcaaagagggtaccccccggcaggagctggcagacccaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatc

SEQ ID NO: 6214 - DNA, 1634 bp, Homo sapiens
tttccggcgtgggtccgggcaagaaccgcttgtagtttggtttaaattctgcacgggaggaccttctgagtttacctgttgggctcctggctgcgcaggcacagcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgccttctgctcaactacgcaattacatctcgtttagcagatgtgttcaaccaaaggtgtgaggtgaaccgaagggcatctgtgagtggctgtgtcattaacacctgtggctgggtcaagggctctggttaccaggctctggtgcatgcagcctcagcttttgaggtggatgtcgttgttgttctggatcaagaacgactgtacaatgaactgaaacgggacctcccccactttgtacgcactgtgctgctccctaaatctgggggtgtggtggagcgctccaaggacttccggcgggaatgtagggatgagcgtatccgtgagtatttttatggattccgaggctgtttctatccccatgccttcaatgtcaaattttcagatgtgaaaatctacaaagttggggcacccaccatcccagactcctgtttacctttgggcatgtctcaagaggataatcagctcaagctagtacctgtcactcctgggcgagatatggtgcaccacctactgagtgttagcactgccgagggtacagaggagaacctgtccgagacaagtgtagctggcttcattgtggtgaccagtgtggacctggagcatcaggtgtttactgttctgtctccagcccctcgcccactgcctaagaacttccttctcatcatggatatccggttcatggatctgaagtagagatcagcaggaagccttgctgcctgggacatagagatcatctggccacccctagaggcagatgggctgagataaaagactgttggggccacctgaccagtaaactgtggactagtagaaagttcatattctacctctaaaaacaggtagtggtaacctgactcttctaatcttgaaccaaaaggaaaaccatgagactgtaattggtttcttagaccacctaagatgccactttgaattctctaagaccctggagaattgcatttctttcactgtgctactatgtggtttttaaaaaatcaatgctttatattccatatgtggttcttacccatttatctaggatgaaagtgtgaattagagggactccttccaataaagttcaaacttaaaaaaaatcattttaataaatatttttgccatatcat

SEQ ID NO: 6215 - DNA, 1691 bp, Homo sapiens
cgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagcaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgtttttt

SEQ ID NO: 6216 - DNA, 1738 bp, Homo sapiens
gcgcgggctccgggcgctcccggcatccctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatt

SEQ ID NO: 6217 - DNA, 1644 bp, Homo sapiens
atccctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgtttttt

SEQ ID NO: 6218 - DNA, 2229 bp, Homo sapiens
cggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgggcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccaggaaatttgatcaagcatcttgttaaaggaactcggcctttgttcctggaaactaggattccatggcatatggggcacagcatagaggaaatacccatttttggcctaaaagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatgggg

SEQ ID NO: 6219 - DNA, 6616 bp, Homo sapiens
ctcggaagtgacgcaagcgcccccccaccgccgctagatccgctgctgctgccgcggcgggcagacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgggcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggaggcagttcccgtgcagcatttccacaaggtggtagaggacggggccgttttccaggggctgttcctggtggggacagatttcctgggccagcaggaccaggagggccacccccaccttttccagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaattttgcaaagtccttctctacctgataacacgtgaatgtatagcagtaaaggtgaaaattgcaggccttgttttgttcttcatacccccttcagttgtttatgggttaatgttatttgaaaactcttcctttttttaatgtgtaaaaacaatccaaagagataaatccttgcatagacaccaaaaacagtgtctcagagaccttttcattttttccttagttaataactgtagtggatgtgaaaacaaacgagttgaattttaaaacatagcatttattagtgctatacagtcacattcctttcagccagtagtaaagttaaacagatgagtgatacagtacctgaatggtactgcttctgaggcaacactttggattgaaagtgctgcttttggttaaaggaactatgttgtggaaagcatattccagtgtaaatttgcagatgtgtgttttttttttttgtcacttttcataaggtttggagtaagttgcagtggcttttgatcatagtttagcccatttaatggtccttttacctagaatgttcttaagcagttaatgacaatttggaatacacagataacttgtagcttaagatactattttcatttaattctcctgtggagaatattgctttattttttactagtttcaggtcagttattaaaataaacatggaggttttaatgaatgttgtataatattttatagtgaaggaaaattgtggaaagggcaaagactttctctttcccttatgtatttaactgtgccaatctaaatacatactgttttatacaatgagatgcattacaagacttttctgttggagtgctctcgacattttggttttcatacctgaatgatcattgcattttctgtattttctaaaatggctccaattttgtgttttaagcttcagcttaagaggaagtttatgttctaattcttgactgagaatacagtattgagattctctgttttacagataacaactggtttttattactcattaagttcatttgcatcccgtagccctctgtaaatgtttcccctagttgtatgtacgtaaatgcacgcttatccagtgtatattagacatttttgtgctaaaatatattaagtgggatttttgtagcaaagcattctatttttctgttcttacagtgtgtgtgtgtgtgtgtgtgtgtgtgtatgcgtttttttaaccttaacttcagtttaaacactggtgtatttatttttttaagcaacttgactcttagaagccttagactgattttttcaataaatattcaaccaaaaattataaatttattaagatgtggccttacatatggcattccttgtgttcgtaatgtgagatttttgatttagataaatcaagattcaggattaaagtttcattgtaagttgaaatagaaaatgtattaaaatgtctaggcttctgggaggaagttcttatactcttctttcttggcattagaaagaagcaatatgaatttttgtgaatattctaaatattcaggcaacactgttcagattgatttaggtttgtcttaaccaatgttctttttttagaatttcaggttgtggcattcactgagtatgcagctactatggtttttgtatgggacgtataaatacttgattatatacgacagattttaatgtctttaaagacttcctgctgtattaacatattgtaatggagtcttttaaatactaggttgaatttaattgaagtcacacacatcttgaagtggtaactgcatagtaaatactaccaagagtttttttcacgtgggagtatcctaaaactctgccatgggtgtaaatgttttacattaatttcataattggacagaccctgcatttagcgaaaacattttgttttgaaagtgtgttctttttgtcgcactgttactgcgtaacacttctcaacattctgtaagttaaattattttaaaataactatggtgaattcatgtttatttttttactttgaaaattgtagtactcaggtggtatttaatgggaaaggatcctttgggtataaatcataatgtattttaaggaatgcatctataacattgataactttagccttaaaaaaaaggtctattattccttcctctgcatcccatggtatattagcaaagtagtttacagccctgtacagccttacaaagttgttttacaatttttaatggaaagcccttaacaacaacaacaaaaaattgtatcattttaccaatatccacgaattactgatcacagtttgtaaataatttgtttaatatcagaaggccaaagaaagtcttaaaattttagctattgactctatggtgacttcacaataagatttctgtgcaaaaaggtaaggtgataattgatctaatagacttttttttttttttttttgctgtccatgagaattagacttcatattagcttcaattaaaaagctcattccattttattaaaatgtttgtaattgcaattttgtgtttaatgtttactttgtctttcctttctttagcatttaggtgactgttcggcagtttgatatatggccattgtcggccttaaactgcactagtaacaagcatggtatttatcttgtattgaaaataaaacaaacttttgataaga

SEQ ID NO: 6220 - DNA, 1915 bp, Homo sapiens
gacctgcaggaggcggcggcggcggcggcggccgaggctgaaggaagatggcggacggcgtggaccacatagacatttacgcggatgtcggcgaagagttcaaccaggaagctgaatatggtgggcatgatcagatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatggtggacaacagatgaagacttaactgaagcagttcattctttgggagtaaatgatattttggagataaaattttttgaaaatcgggcaaatggccagtcaaaggggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaactacacaatcaggacaaatgtctggggaaggtaaagctggtcctccaggagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttccacctcgtccacccggtccacttgggccaccccttacactagctcctcctccgcatcttcctggaccacctccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaagggaaatggatactgcaagaacgccattgagtgaagctgaatttgaagaaatcatgaatagaaatagggcaatctcaagcagtgctatttcgagagctgtgtctgatgccagtgctggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatgggg

SEQ ID NO: 6221 - DNA, 4109 bp, Homo sapiens
agacgcctcgaagaatccgctatcggctgtctgcacaaccggaatcatgtcgagtttggcggtgagagacccggcaatggatcgatcactgcgttccgtgttcgtggggaacattccatatgaggcaactgaggagcagttaaaggacattttctcggaggttggttctgttgtcagtttccggctggtatacgatagagagacgggaaaacccaagggctatggcttctgcgaataccaagaccaggagaccgcgcttagtgccatgcggaacctcaatgggcgggagttcagtgggagagcgcttcgggtggacaatgctgccagtgaaaagaataaggaggagttaaagagccttgggcctgcagcgcccattattgactcaccctatggggatcccatcgatccagaagatgcccctgaatcgattaccagagcagtagccagtctccccccggagcagatgtttgagctgatgaagcagatgaagctctgtgtccaaaacagccaccaggaagctcgaaacatgttacttcaaaatccacaactggcttatgcactgttgcaggcacaagtagtgatgagaatcatggatccagagattgctctgaaaattctgcatcggaagatacatgtcacaccactgatcccaggcaaatctcagtctgtgtctgtctctggccctggccctggccctggccctgggctctgcccaggacctaatgttctgctgaaccagcagaatcctccagctcctcagcctcagcatttggctagaagacctgtgaaggacattcctcctctgatgcagactcctatccagggtggaattccagctccagggccaataccagctgcagttcccggagctggtcctggttccttaactcctggaggagcaatgcagccccaacttggaatgccaggggttggcccagtgcctttagagcggggacaagtgcagatgtcagatcctagagctcctatacctcgcggacccgtgactcctggtggtctgcctcctcgaggactgttaggagatgctccaaatgacccacgtggagggactttgctttcagtcactggagaagtggagcccagaggttatctgggtccaccccatcagggtccccccatgcatcatgcctctggtcatgacactcgtggcccttcctcacatgagatgaggggagggccattaggagatcccagactgctaattggagagcccagaggccccatgatagatcaaaggggtctacctatggatggtagaggtggtagagattctcgagcgatggagactcgtgccatggaaactgaggtcttagagacacgtgtaatggagaggagaggaatggagacctgtgcgatggaaaccagagggatggaagcaaggggcatggatgcaagaggattggagatgaggggccctgtccccagttcaagaggccctatgactggtggaattcagggtcctggtcccattaatataggggcaggtggccctcctcagggacccagacaggtcccaggcatttcaggggtggggaatcctggagctggtatgcagggtacaggcatacaaggaacaggcatgcagggagcaggcatacaaggaggagggatgcagggggcaggcatacaaggagtcagtatacaaggaggaggtatacaaggaggaggtatacagggggcaagcaagcaaggtggaagccagcctagcagttttagtcctgggcagagccaggtcactccacaggatcaggagaaggcagctttgatcatgcaggttcttcaactgactgcagatcagattgccatgctgccccctgagcaaaggcagagtatcctgattttaaaggaacaaatccagaaatccactggagcgtcttgaaaggttttagaaaatatttggctgtagtctcaaattttattctgtagcatggagaatgggtgcaaaaagctgacttctgtatccccacacttggattagggtttccctcctcctagaacctaatcttattttttgttctttttctttctttctgttttccttttttttttaattgagggtggggggaggagggagtgcgtctgttcactttaagttactttaaaataactctgaacatgattatattatgccaaataagattacaaagaataagcagcaatattgaagcatctacagtatgttaactacattttttaaatgtcgagtaaaacttcgtgaaaactgctcataaagactaaaagttgacctgttaaaacgttaatgtactaagatagttttaagatttttggttgtataacaaaataaaagtttacccaaaagtataagatacattttttggtaaaccatttaaaatacaaaatcctattttggaggcaataggataagcattgtcttagtgttttagaattatttttgaaacagagttaacaggataaggttacacttgtattagaattgtttttttctaaagttatgttacctgaaaaatcaaggagtgcacctgatttactgttgcttcatttatcccatccttcagagaccagcaaggttctgccaggccccaagcatctgagcatgatgattttgctgtgacaattctaagatcaaccaggttacttaagtccgctctgatgaaacccagtctctcaataccttcctatttctcaatagtctttaagccctaaatctgagtcagtaattctctaaaaatccttcccaaaaatcagtgtctagggactggttgatctagatgagttataaatggtatttgacttttcataagtagtggaaggtttcactaagtaaagatctgagtttcttggtatctgacgtttgtatacagatggtgtccatttgctcaaccagacaggagttaacttgtattagaattgttttttctaaagttatgttacctgagaaattaaggactgcacctggtttaatgttgcttcacttatcccaccctacagagaccagcaaggttctgccaggcctcgagcatccaagcatgattttgctgtgacaaatctaaaatcaaccaggctacttaagtctgctctgatgaaacccaataatctctcaataccttcctatttctcaatagtctttaaaccctaaatctgagtcagtaattctcttacatccttcccaaaaatcagtgtctagggactagttgatctggatgagttatacatgatatttgacttttcataagtagtggaaggtttcactaagtaaaactctcagtttcttggtatctggctttcttatacagatggtgtccatttgctccaccagacaggagttaaaaacctttaaagagcatttaacatgccttttagttttcttatttcataatctacttttctatcattaatcatcttaccaggaataatcaaggcccaggtaggtagaagtttttatatagcctgaatactcacttgacttactgctcattttactttttgcatggaatacagccatttagtcctaatatacataccaatgagacaattaaaaattggttggaagatggagcttatcacattgtgctactacgactttattttttcttgaaaataaagccttgaggatgtgaacataaatgttggtatcataaaacaagtagtaataaaagcataaattatcaaatatcaggtgatcttactatggagaagaaaaaccaatatctagttacagatgaaaaaatgtttaatacaaagagctgaaaatgtagaaattgagttatcttccctttgcaaaatttttacactttaaattagtaattctttgtttgcaaggttttcatccctatgctgttgttttctactacctgttttactcttgttcatactgctactttcccatgtttcctatatgcctcccctatattggagaggataactcgcgtttacatatgtgatagttatgcttaatactaattcacagagttggctcgatcattttgagattctagttgctttatctcaaagctttcactgaagggctgtaactgaaaattattaaatgttagtctttagtcaaatctctgcattgtttcatgcagaaaataaagatacaattaaggctg

SEQ ID NO: 6222 - DNA, 3580 bp, Homo sapiens
tttctagtaaccggcgccgttcccggccggggcagggaacggtgcgcctgcagagccagatttcggcccaaggggcgcgggagtctcttcgggcgtccgggatcccctggcgcggctccgtgctgcctaacggggcaagtcgcatgcgcaccgagccgcgctggggaaagggagagtgaggggaggggcgagcgcagagcctccgccggccgtctgagcccgcggggtcgctgacgacgcatgcgccgggagggggcgcaatcacggactcggcttgcggctgccggtttaaaaaaggaaaccccggagagcgagagcgcgaaggaaatctggccgccgccgccgcgagcgctcccgaatttttacttgttcctgcaaagctgctggagctcagaagctgattctatcacattgtaagatgcctttggataattctacagtcctcttaaatgaatctttagaacttggcaagtctcactagataccttcaatcatcattttgagctcaaagaattctgagacttatggttggtcatatagaagagtaccttgaacctatagtttcctgaagaatcagtttaaaagatccaaggagtacaaaaggagaagtacaaatgtctactacaagacgaaaacgtagtatgttatgttgtttaccgtaagctgtagtaaaatgagctcgattgttgacagagatgacagtagtatttttgatgggttggtggaagaagatgacaaggacaaagcgaaaagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaaccccagaatatttaaaatcaaaaaatcagttagaattctgttgtcacatgctgcgaggaacaatagacccaaaggagccatctacctatgaatatgtaaaatttataggaaatttcaaatctttaaacagtgtatcctcttcagcacacaatggttttgaaggaactatacaacgcacacataggccatcttatgaagatagagtttgttttgtagctactgtcaggttagctacacctcagttcatcaaggaaatgtgcactgttgaagaacccaatgaagagtttacatctagacatagtttagaatggaagtttctgtttctagatcacagggcaccacccataatagggtatttgccatttgaagttctgggaacatcaggctatgattactatcatgtggatgacctagaaaatttggcaaaatgtcatgagcacttaatgcaatatgggaaaggcaaatcatgttattataggttcctgactaaggggcaacagtggatttggcttcagactcattattatatcacttaccatcagtggaattcaaggccagagtttattgtttgtactcacactgtagtaagttatgcagaagttagggctgaaagacgacgagaacttggcattgaagagtctcttcctgagacagctgctgacaaaagccaagattctgggtcagataatcgtataaacacagtcagtctcaaggaagcattggaaaggtttgatcacagcccaaccccttctgcctcttctcggagttcaagaaaatcatctcacacggccgtctcagacccttcctcaacaccaaccaagatcccgacggatacgagcactccacccaggcagcatttaccagctcatgagaagatggtgcaaagaaggtcatcatttagtagtcagtccataaattcccagtctgttggttcatcattaacacagccagtgatgtctcaagctacaaatttaccaattccacaaggcatgtcccagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctgggttgaattttggttccgttcaactttcttctggaaattcatctaatatccagcaacttgcacctataaatatgcaaggccaagttgttcctactaaccagattcaaagtggaatgaatactggacacattggcacaactcagcacatgatacaacaacagactttacagagtacatcaactcagagtcaacaaaatgtactgagtgggcacagtcagcaaacatctctacccagtcagacacagagcactcttacagccccactgtataacactatggtgatttctcagcctgcagccggaagcatggtccagattccatctagtatgccacaaaacagcacccagagtgctgcagtaactacattcactcaggacaggcagataagattttctcaaggtcaacaacttgtgaccaaattagtgactgctcctgtagcttgtggggcagtcatggtacctagtactatgcttatgggccaggtggtgactgcatatcctacttttgctacacaacagcaacagtcacagacattgtcagtaacgcagcagcagcagcagcagagctcccaggagcagcagctcacttcagttcagcaaccatctcaggctcagctgacccagccaccgcaacaatttttacagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcatagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactg

SEQ ID NO: 6223 - DNA, 1392 bp, Homo sapiens
ttgtttccggcgtgggtccgggcaagaaccgcttgtagtttggtttaaattctgcacgggaggaccttctgagtttacctgttgggctcctggctgcgcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgccttctgctcaactacgcagtgcgtttgggccgccgtcccacttatgtggagctggatgtgggccagggttctgtgtccatccctggtaccatgggggccctctacatcgagcggcctgcagatgtcgaagagggtttctctatccaggcccctctggtgtatcattttggttccaccactcctggcactaacatcaagctttataataagattacatctcgtttagcagatgtgttcaaccaaaggtgtgaggtgaaccgaagggcatctgtgagtggctgtgtcattaacacctgtggctgggtcaagggctctggttaccaggctctggtgcatgcagcctcagcttttgaggtggatgtcgttgttgttctggatcaagaacgactgtacaatgaactgaaacgggacctcccccactttgtacgcactgtgctgctccctaaatctgggggtgtggtggagcgctccaaggacttccggcgggaatgtagggatgagcgtatccgtgagtatttttatggattccgaggctgtttctatccccatgccttcaatgtcaaattttcagatgtgaaaatctacaaagttggggcacccaccatcccagactcctgtttacctttgggcatgtctcaagaggataatcagctcaagctagtacctgtcactcctgggcgagatatggtgcaccacctactgagtgttagcactgccgagggtacagaggagaacctgtccgagacaagtgtagctggcttcattgtggtgaccagtgtggacctggagcatcaggtgtttactgttctgtctccagcccctcgcccactgcctaagaacttccttctcatcatggatatccggttcatggatctgaagtag

SEQ ID NO: 6224 - DNA, 1778 bp, Homo sapiens
aaggtagtaaaaagaggattatagacgtggtggaacctgttggctgcggggcaaatgactgacctgcacagcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgccttctgctcaactacgcagtgcgtttgggccgccgtcccacttatgtggagctggatgtgggccagggttctgtgtccatccctggtaccatgggggccctctacatcgagcggcctgcagatgtcgaagagggtttctctatccaggcccctctggtgtatcattttggttccaccactcctggcactaacatcaagctttataataagattacatctcgtttagcagatgtgttcaaccaaaggtgtgaggtgaaccgaagggcatctgtgagtggctgtgtcattaacacctgtggctgggtcaagggctctggttaccaggctctggtgcatgcagcctcagcttttgaggtggatgtcgttgttgttctggatcaagaacgactgtacaatgaactgaaacgggacctcccccactttgtacgcactgtgctgctccctaaatctgggggtgtggtggagcgctccaaggacttccggcgggaatgtagggatgagcgtatccgtgagtatttttatggattccgaggctgtttctatccccatgccttcaatgtcaaattttcagatgtgaaaatctacaaagttggggcacccaccatcccagactcctgtttacctttgggcatgtctcaagaggataatcagctcaagctagtacctgtcactcctgggcgagatatggtgcaccacctactgagtgttagcactgccgagggtacagaggagaacctgtccgagacaagtgtagctggcttcattgtggtgaccagtgtggacctggagcatcaggtgtttactgttctgtctccagcccctcgcccactgcctaagaacttccttctcatcatggatatccggttcatggatctgaagtagagatcagcaggaagccttgctgcctgggacatagagatcatctggccacccctagaggcagatgggctgagataaaagactgttggggccacctgaccagtaaactgtggactagtagaaagttcatattctacctctaaaaacaggtagtggtaacctgactcttctaatcttgaaccaaaaggaaaaccatgagactgtaattggtttcttagaccacctaagatgccactttgaattctctaagaccctggagaattgcatttctttcactgtgctactatgtggtttttaaaaaatcaatgctttatattccatatgtggttcttacccatttatctaggatgaaagtgtgaattagagggactccttccaataaagttcaaacttaaaaaaaatcattttaataaata

SEQ ID NO: 6225 - DNA, 566 bp, Homo sapiens
attcccagtcaagccaaggaaaggctgcacagaaggccagagaatcacaaaggggagtaggggtcattttttcacccatctcggatcacagggagaagcaagttgggcaaatgactggagaaaaaacaaaggcaagccgagtgctggggagagatgttcccctgaagtgagacggggctggaccgtaggagaaaggggagagggagggctggcgggggcaactgacagctgacagcagaggcgccgaggcggaggctggaggaaccaggcacagcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctt

SEQ ID NO: 6226 - DNA, 2435 bp, Homo sapiens
atgactgacttgtagctggaagaaatcatcggatttttattcttttattaaagaaaaaaaatttgaaatgccttccatgtgccaagcactgtgtcaggtgggagatgacagcttggtgaaacctctgtcaggctgtcttcctccgctttctctatccctgggtttccccctgcctaaaaaggattttgtgcttcgtggcttgtccaggcaagcaggccgtcgcgggacctagaccgagacagtgagtctctctttctcccgggcctcccttctgtttcctgggctgcaggggagcaggaaatctggggcgagattcccgccgcggacgcgcactgccgaagcctggtccctcgacctgtccctgcccagcgcgggggcgcaaccgccacgcctcctcacccctccctccggctgcacgaataatgacaacagccgcccctcccacctttggcgtcacgttcaaaacaatcctttgactacaactcccagaaggccgagcggcttagcgagtgcacccgctctcggctgctccggcaaactacacatcccaaagggcagcgcgcgaccgcgtgtcctttcacagcgcaagtgcggaactgcgtttgtttccggcgtgggtccgggcaagaaccgcttgtagtttggtttaaattctgcacgggaggaccttctgagtttacctgttgggctcctggctgcgcaggcacagcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgccttctgctcaactacgcagtgcgtttgggccgccgtcccacttatgtggagctggatgtgggccagggttctgtgtccatccctggtaccatgggggccctctacatcgagcggcctgcagatgtcgaagagggtttctctatccaggcccctctggtgtatcattttggttccaccactcctggcactaacatcaagctttataataagattacatctcgtttagcagatgtgttcaaccaaaggtgtgaggtgaaccgaagggcatctgtgagtggctgtgtcattaacacctgtggctgggtcaagggctctggttaccaggctctggtgcatgcagcctcagcttttgaggtggatgtcgttgttgttctggatcaagaacgactgtacaatgaactgaaacgggacctcccccactttgtacgcactgtgctgctccctaaatctgggggtgtggtggagcgctccaaggacttccggcgggaatgtagggatgagcgtatccgtgagtatttttatggattccgaggctgtttctatccccatgccttcaatgtcaaattttcagatgtgaaaatctacaaagttggggcacccaccatcccagactcctgtttacctttgggcatgtctcaagaggataatcagctcaagctagtacctgtcactcctgggcgagatatggtgcaccacctactgagtgttagcactgccgagggtacagaggagaacctgtccgagacaagtgtagctggcttcattgtggtgaccagtgtggacctggagcatcaggtgtttactgttctgtctccagcccctcgcccactgcctaagaacttccttctcatcatggatatccggttcatggatctgaagtagagatcagcaggaagccttgctgcctgggacatagagatcatctggccacccctagaggcagatgggctgagataaaagactgttggggccacctgaccagtaaactgtggactagtagaaagttcatattctacctctaaaaacaggtagtggtaacctgactcttctaatcttgaaccaaaaggaaaaccatgagactgtaattggtttcttagaccacctaagatgccactttgaattctctaagaccctggagaattgcatttctttcactgtgctactatgtggtttttaaaaaatcaatgctttatattccatatgtggttcttacccatttatctaggatgaaagtgtgaattagagggactccttccaataaagttcaaacttaaaaaaaatcattttaataaatatttttgccatatcatagaa

SEQ ID NO: 6227 - DNA, 553 bp, Homo sapiens
aactgcgtttgtttccggcgtgggtccgggcaagaaccgcttgtagtttggtttaaattctgcacgggaggaccttctgagtttacctgttgggctcctggctgcgcagatctgatatttaatttgtgttctaggcacagcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgcc

SEQ ID NO: 6228 - DNA, 1151 bp, Homo sapiens
ccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaacccgatctgcacctggtgcgtgggccaggccgccagcatgggctccctgcttctcgccgccggcaccccaggcatgcgccactcgctccccaactcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtctttgc

SEQ ID NO: 6229 - DNA, 2500 bp, Homo sapiens
acttccggcaggcggcggggcccggaagcggcgcgcggggccggcgaatcccgcggcgccaggtgggagcggggccggagcatgcggggcggccggcggtctgcggcgcgcggcgcattcgttcccccgcggcggtggcggtggcgcgcggcggctctccagtgagcggcggagcccggagcggcgggctgggcgccgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcatttttcttgacctggtataatgaaagtatttcggatatttgagtttaacccttttccagaaagtaatacatgatatggatttatttatgcattaaaagagcaaatttaaagagccctttgcaa

SEQ ID NO: 6230 - DNA, 2053 bp, Homo sapiens
gctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaacatcgacctggtcttgaatgtggaagactttgatgtggagtccaaatttgaaaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacagcagatcgaggcggagaagaagccgacgagtgccctggatgagccagtgtcccactggcgaccgcggctggcgctgaacgtgatggcggacaactttgtctttgacgggtcctccctgcctgccgatgtgcatcggtacatgaagatgatccagctggggaaaaccgtgcattacctgcccatcctgttcatcgaccagctcagcaaccgcgtgaaggacctgatggtcataaaccgctccaccaccgagctgcccctcaccgtgtcctacgacaaggtctcactggggcggctgcgcttctggatccacatgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggc

SEQ ID NO: 6231 - DNA, 3080 bp, Homo sapiens
tgtgtcttggactgggacagacagccgggctaaccgcgtgagaggggctcccagatgggcacgcgagttcaggctcttccctactggaagcgccgagcggccgcacctcagggtctctcctggagccagcacagctattcgtggtgatgatgcgccccccggcgcccccagcccggtgctgcaccggcccccacctcccggcttccagaaagctccccttgctttccgcggcattctttgggcgtgagtcatgcaggtttgcagccagccccaaagggggtgtgtgcgcgagcagagcgctataaatacggcgcctcccagtgcccacaacgcggcgtcgccaggaggagcgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctgatcgcttggagggtcctctttttatgttgagttgctgcttcccggcatgccttcattttgctatggggggcaggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgcaaatggaagcttttctgttctattataaaactgtcgatgtattctgaccaaggtgcgacaatctcctaaaggaatacactgaaagttaaggagaagaatcagtaagtgtaaggtgtacttggtattataatgcataattgatgttttcgttatgaaaacatttggtgcccagaagtccaaattatcagttttatttgtaagagctattgcttttgcagcggttttatttgtaaaagctgttgatttcgagttgtaagagctcagcatcccaggggcatcttcttgactgtggcatttcctgtccaccgccggtttatatgatcttcatacctttccctggaccacaggcgtttctcggcttttagtctgaaccatagctgggctgcagtaccctacgctgccagcaggtggccatgactacccgtggtaccaatctcagtcttaaagctcaggcttttcgttcattaacattctctgatagaattctggtcatcagatgtactgcaatggaacaaaactcatctggctgcatcccaggtgtgtagcaaagtccacatgtaaatttatagcttagaatattcttaagtcactgtcccttgtctctctttgaagttataaacaacaaacttaaagcttagcttatgtccaaggtaagtattttagcatggctgtcaaggaaattcagagtaaagtcagtgtgattcacttaatgatatacattaattagaattatggggtcagaggtatttgcttaagtgatcataattgtaaagtatatgtcacattgtcacattaatgtcacactgtttcaaaagtta

SEQ ID NO: 6232 - DNA, 1530 bp, Homo sapiens
aacgcggcgtcgccaggaggagcgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagagctcgcccttctacttctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctg

SEQ ID NO: 6233 - DNA, 2098 bp, Homo sapiens
aacactggcagggcagcctgctgtcggcttagaggggatgggcagtgtggagggcctggcagagcaagaggactcatccttccaaagggactttctctgggaagcctgctcctcgggccactgcgaaccctctctactctccgaagggaattgtccttcctggcttccactacttccacccctgaatgcacaggcagcccggcccaagtctcccactagggatgcagatggattcggtgtgaagggctggctgctgttgcctccggctcttgaaagtcaagttcagaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctgatcgcttggagggtcctctttttatgttgagttgctgcttcccggcatgccttcattttgctatggggggcaggcaggggggatggaaaataagtagaaacaaaaaagcagtggctaagatggtatagggactgtcataccagtgaagaataaaagggtgaagaataaaagggatatgatgacaaggtt

SEQ ID NO: 6234 - DNA, 737 bp, Homo sapiens
gatggattcggtgtgaagggctggctgctgttgcctccggctcttgaaagtcaagttcaggtggtgctgagactccctgggggctgcagcgctgtgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctac

SEQ ID NO: 6235 - DNA, 2381 bp, Homo sapiens
catccttccaaagggactttctctgggaagcctgctcctcgggccactgcgaaccctctctactctccgaagggaattgtccttcctggcttccactacttccacccctgaatgcacaggcagcccggcccaagtctcccactagggatgcagatggattcggtgtgaagggctggctgctgttgcctccggctcttgaaagtcaagttcaggtggtgctgagactccctgggggctgcagcgctgtggtgaatggggagcgtctgctggggtgaaggtttaggtgcacattgcagaggacgtggctggtctctgggatgcagtccctctgtggaggtggcatggggagggacggatgcatgacctaaggggggtattttcagtgtctgacatgatcgataccactctggacaaggaggccaggatgcagaaagcctgtgtgcctcgctgattgtcggggaggatgtggcttggacaagagcctggttcctccgatgccagggttcttgtttcttccactcaacattgctgtcctgcagtccctccctccctgcacctcctgccttcgctttcattcgaggtgtccatggcaagtctggtcatttccccccatttcctcaggaataaaagtgcagcagtgcctgctgtggggacagctgagggcagtgaggccctggggagctgctgcaggcagcaggtgggcgggacgccagcaggctgtctagctgttcccatgatggtctcctgttctctgcagaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctga

SEQ ID NO: 6236 - DNA, 878 bp, Homo sapiens
caggaggagcgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgc

SEQ ID NO: 6237 - DNA, 2836 bp, Homo sapiens
tctttgcgcctgattacttctcatgagaggcactccttgttaatgtgctactgagtgtccagatgggcctgctgggctgagcgggctttggatgtgaaccatttcaggaaggggaaccccatcgtcctgttggttctgtgatggcaaatggaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctgatcgcttggagggtcctctttttatgttgagttgctgcttcccggcatgccttcattttgctatggggggcaggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgcaaatggaagcttttctgttctattataaaactgtcgatgtattctgaccaaggtgcgacaatctcctaaaggaatacactgaaagttaaggagaagaatcagtaagtgtaaggtgtacttggtattataatgcataattgatgttttcgttatgaaaacatttggtgcccagaagtccaaattatcagttttatttgtaagagctattgcttttgcagcggttttatttgtaaaagctgttgatttcgagttgtaagagctcagcatcccaggggcatcttcttgactgtggcatttcctgtccaccgccggtttatatgatcttcatacctttccctggaccacaggcgtttctcggcttttagtctgaaccatagctgggctgcagtaccctacgctgccagcaggtggccatgactacccgtggtaccaatctcagtcttaaagctcaggcttttcgttcattaacattctctgatagaattctggtcatcagatgtactgcaatggaacaaaactcatctggctgcatcccaggtgtgtagcaaagtccacatgtaaatttatagcttagaatattcttaagtcactgtcccttgtctctctttgaagttataaacaacaaacttaaagcttagcttatgtccaaggtaagtattttagcatggctgtcaaggaaattcagagtaaagtcagtgtgattcacttaatgatatacattaattagaattatggggtcagaggtatttgcttaagtgatcataattgtaaagtatatgtcacattgtcacattaatgtc

SEQ ID NO: 6238 - DNA, 2841 bp, Homo sapiens
ctttccgcggcattctttgggcgtgagtcatgcaggtttgcagccagccccaaagggggtgtgtgcgcgagcagagcgctataaatacggcgcctcccagtgcccacaacgcggcgtcgccaggaggagcgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctgatcgcttggagggtcctctttttatgttgagttgctgcttcccggcatgccttcattttgctatggggggcaggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgcaaatggaagcttttctgttctattataaaactgtcgatgtattctgaccaaggtgcgacaatctcctaaaggaatacactgaaagttaaggagaagaatcagtaagtgtaaggtgtacttggtattataatgcataattgatgttttcgttatgaaaacatttggtgcccagaagtccaaattatcagttttatttgtaagagctattgcttttgcagcggttttatttgtaaaagctgttgatttcgagttgtaagagctcagcatcccaggggcatcttcttgactgtggcatttcctgtccaccgccggtttatatgatcttcatacctttccctggaccacaggcgtttctcggcttttagtctgaaccatagctgggctgcagtaccctacgctgccagcaggtggccatgactacccgtggtaccaatctcagtcttaaagctcaggcttttcgttcattaacattctctgatagaattctggtcatcagatgtactgcaatggaacaaaactcatctggctgcatcccaggtgtgtagcaaagtccacatgtaaatttatagcttagaatattcttaagtcactgtcccttgtctctctttgaagttataaacaacaaacttaaagcttagcttatgtccaaggtaagtattttagcatggctgtcaaggaaattcagagtaaagtcagtgtgattcacttaatgatatacattaattagaattatggggtcagaggtatttgcttaagtgatcataattgtaaagtatatgtcacattgtcacattaatgtc

SEQ ID NO: 6239 - DNA, 1039 bp, Homo sapiens
tctttgcgcctgattacttctcatgagaggcactccttgttaatgtgctactgagtgtccagatgggcctgctgggctgagcgggctttggatgtgaaccatttcaggaaggggaaccccatcgtcctgttggttctgtgatggcaaatggaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccggg

SEQ ID NO: 6240 - DNA, 4003 bp, Homo sapiens
ttaggacagtttgagcagccaactgggtacatggaaaactcagtctcctacagcgcaattgaagacgttcagctgctgtcctgggagaatgccccgaagtactgtttacagctcacgattcctgggggaactgtcttactgcaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggccccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggaggggggagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccctcactgtacagaacagcccgttgatggtttatttggggtccccctctccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgtttttagttgtttggttttcttttctttcccccctccggtcccatacttcacagcactctggtgcgggaagaagcagaagcaaaaaaaataaaaataaaaaaataaataaaaataaaaaaaataaaaaaggaaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaa

SEQ ID NO: 6241 - DNA, 4357 bp, Homo sapiens
gggggccccgccgccccagcagcccaggacagccccctctccccgcccccagccccctcccccggcgcggccatggatgtgaccagcagctcgggcggcggcggcgacccccggcagatcgaggagaccaagccgctgctggggggcgacgtgtcggcccccgaaggcacgaagatgggcgccgtgccctgccgccgggctcttctgctttgcaacgggatgaggtacaaactgctgcaggagggcgacattcaggtctgtgtcatccggcacccgcggacctttctcagcaagatcctcacctcgaaattcctgaggcgctgggagccgcaccacctaacgctggccgacaacagcctggcgtccgccacgccaactgggtacatggaaaactcagtctcctacagcgcaattgaagacgttcagctgctgtcctgggagaatgccccgaagtactgtttacagctcacgattcctgggggaactgtcttactgcaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggccccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggaggggggagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccctcactgtacagaacagcccgttgatggtttatttggggtccccctctccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgtttttagttgtttggttttcttttctttcccccctccggtcccatacttcacagcactctggtgcgggaagaagcagaagcaaaaaaaataaaaataaaaaaataaataaaaataaaaaaaataaaaaaggaaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaa

SEQ ID NO: 6242 - DNA, 4131 bp, Homo sapiens
ggcttcttggatgggctgggcgtgcatggcataaccgtttgagaacaacaaaccaagccggccgggctgccgctctgtttcctgcgaggagggaagttacagatctccgccctggcgtccggggaaggatgggacaggctgctgagccaactgggtacatggaaaactcagtctcctacagcgcaattgaagacgttcagctgctgtcctgggagaatgccccgaagtactgtttacagctcacgattcctgggggaactgtcttactgcaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggccccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggaggggggagggggtggggagggggcccacaagcacgcccagcccccgccgaattcttttagcttcgtaattggaacctttgacctgatctaaagtggactttgtagcaacaagaggagcatcagcgggtcggggaggggtttgggggtgggctggggggtgggggaccctttgtggattttctttgcctttgtgtttgatgccgtcgtgtgggaaaagtcaactccgatgccaccattgcgggccggacgaaggatgctttcttcctagaggctccgagctgagctgcgaactcgccccccgcccttgggacaagaagacccagtcacatcactgcacccgtcctgtgtcctcaccattgctatgcaaagtgattcttgttgtacataagatttaaataatgcacctatttaagacatgttgacaaattgcgggtctgggacccgcctcttatttatgaagtctttgaccgtcccccccgcccgaccccaccgccctcccgcccccacctggcgtgtagtactgtataaaccagtcagctgtcgggttagtggtagtattattgttatttttttaaaggaaacaaacagacaacaaaaagaagaaaaaaaaaaagaacctccttggaaaaattaattgctttttcgtaatggattctctatgctaatgctctctcgtctgtctgtctgtctgcccactcccccacccaccactgtgcgtttctgatttccaaatgtctccaactccctcacgaggtggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccctcactgtacagaacagcccgttgatggtttatttggggtccccctctccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgtttttagttgtttggttttcttttctttcccccctccggtcccatacttcacagcactctggtgcgggaagaagcagaagcaaaaaaaataaaaataaaaaaataaataaaaataaaaaaaataaaaaaggaaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaa

SEQ ID NO: 6243 - DNA, 2477 bp, Homo sapiens
gtggtgctgaggagccgagcgggcggggagcctctagctgctccagcatcccacttgctcactgccccctgatcccgtggacagcgcagtcagaggcaggagcaggagaggaggaagcagaggaaaaggaggaggaggaggcggcttgcaactcctcagatccagagccggactccgagctaatgagggagcagcagacacggcctcccaacccttcccccaaggggaacccaggctgccaatagctacctgcgagaccagtggttccattctctgcaatggaagaaaaagatttacaaatataagaaagtgctgagtaacccaagccgctgggaagttgtcttgaaagagatccggaccctggtggacatggccctgacatcccccctgcaggatgactccatcaaccaggccccactggaaatcgtctcgaaactgctctcagagaacacaaacttgaccacccaggagcatgaaaacatcattgtggcaatcgctcctttgctggaaaacaaccacccaccaccagatctctgtgaattcttttgcaagcactgcagagagcggccccggtccatggtggtcatcgaggtgttcacccccgtggtgcagcgaatcctcaagcataacatggactttgggaagtgcccgcgactgaggctgtttactcaggagtacatccttgccttgaacgagctcaacgcggggatggaagtggtgaagaagttcattcagagcatgcacggccccacagggcactgcccccacccccgggtcctgcccaacctggtggccgtgtgcctggctgccatctactcctgctatgaagagttcatcaacagccgcgacaattccccaagcctgaaggaaatccggaacggctgccagcagccgtgcgaccggaagcccactttacctctgcgccttctgcaccccagcccggacctggtgtctcaggaagccacgctgtctgaggcccggctcaagtcggtggtcgtggcctccagtgagatccacgtggaggtggaacgcaccagcactgccaagccggcgctgacggccagcgcaggcaacgacagcgagcccaacctcatcgactgcctcatggtcagccccgcctgcagcaccatgagcatcgagctgggcccccaggccgaccgcacgctcggctgctacgtggaaatcctcaagctgctgtcagactatgatgactggagaccgtctctggccagtttgcttcaacccattccattccccaaagaagctctcgcacatgagaagttcaccaaggaactgaagtacgtgattcagaggttcgccgaagaccccaggcaagaggtccactcatgcctgctgagcgtgcgggccggcaaagatggctggttccagctctacagccccggaggggtggcctgcgacgatgacggggagctgttcgccagcatggtgcacatcctcatgggctcctgttacaagaccaaaaaattcctgctctccctggcagaaaacaagctgggtccctgcatgctcctggcactgagggggaaccagaccatggtggagatcctgtgcttgatgctggaatacaacatcatcgacaacaacgacacccaactgcagatcatctcaaccctggagagcacagacgtggggaagcgcatgtacgagcagctgtgtgaccggcagcgggagctgaaggagctgcaaaggaaaggcgggcccaccaggctaacactgccctccaagtccacagacgctgacttggctcgtttgctgagctccggctccttcggaaacctggagaacctcagtttggccttcaccaatgtaaccagtgcctgcgccgagcacctcatcaaactgccttcgctcaagcagctgaacctgtggtccactcagtttggagacgctggccttcggctcctgtcggaacacctcaccatgctccaggtgctgaacctgtgcgagaccccggtcacagacgctggcctgctggccctgagctccatgaagagtctctgcagtttaaacatgaacagcaccaagctctcagctgacacctacgaagatctgaaggccaagcttcccaatttgaaggaagtggacgtccgctacaccgaagcctggtgaagctcccagctcaaggcaggaagacgtttgcaaccgcgacaaaataactcttgactaacagccgcagagcagccggtcctggggtcccaccctggtgccctggctgtgagatagatggggagtctttctgggggcggaggggggagggggtggggagggggctcaggctggaggaggagggattaagatccccttgctccactaaggcccaagctctttctctcggcaccttttagacttgaatgggaggctgctaacccgccctctccagtccaccccggtaaaagagctgttccccacccccagggagctcctgtccctgtcagcctttgctgtcccctgtcccc

SEQ ID NO: 6244 - DNA, 2818 bp, Homo sapiens
cacatgttgctacctagtaaataaaatcttaagaagatccgtggctttccttcaccagttcatagcatcgtgattcattgcccggattggactcgactctactcactggacatctaaccactccacttaattaacaatacccaccctacaggggtgttgtaaggattaaaatttaaaatacccgtgttttctacagtgcctggctcaaaagctactgcaagctcgttactgctcatcctccagaggcccacatcaagtcagccacgactcaaggagactccaaagataaaagctgaagccaaaatatatgattctaaacaccctcctcggctactgcaaagcactgtgagcactttctcaggacgagagccaagaagcccagcacctatgggtcaccacagtttccgaggtcccagatgaaaaagatgcgctcgctaccaccgtgcggcggtcctttctctcgcaatagtctcaatgctcccgggccctgcctccggacgccaggacagaggtaccaaaatctcacctcctgcaaagaaacctaattgctacgggggccggaagaggaagaggtgcggctccgacagccagaggggcgggcatacgcagcctccctcggctcagcctgctactggggatgcagagcgtcctggtcgccatgaaaacaggccacacctcggcgatcccggccggtggtttgcaagtgcgcaggcgcgcgcccccttccgcgcatgagcagtgctgctcccaacccgccagtcgcggtctccggcgccagctacgccgctgccgctgtcactatggcccattacaaagccgccgactcgaagcgtgagcagttccggaggtacttggagaagtcgggggtgctggacacgctgaccaaggtgttggtagccttatatgaagaaccagagaaacctaacagtgctttggattttttaaagcatcacttaggagctgctactccagaaaatccagaaatagagctgcttcgcctagaactggccgaaatgaaagagaagtatgaagctattgtagaagaaaataaaaaactgaaagcaaagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggtcttaaagcaggagaatccaaagtaaatcctgaacaaaacctaaacacagccatctaactcattaccttaaaagacattctgtttattagtctgattaggaatgatggcactggttgtattttagccaagacagtttagcatggagctattccttggtgcagttcaggatatgaacacaggtacagtcattctttgaaggtgacactgttctgtatattccctataggcagctggagagatctgtgtgacacaagatgcttttgtacgggttcccatgaatcttctgctcttgtttgtgtgacatggaacaaataacttctttgccaccactttgccttagataactgtgtgtgtgtgtgccagtttgaactctgacaccacattttccttctatgcaatcatgcctgtctgataatcttgcattgctttcctctgagctttagtgggtcctagttgcacactggcctttctgtgctgtttttcaatttgcctaataatagcagttaccctgattgtaatttatgtaactttaaacaggatcacactgtaccccctgcctgccttatttgcttactgagcacaggacagaggcaatatacaactctgggttcacacacaagctgagatgagaagaggaatgagccatatattggggaaaatcatagtttgtaggtataattatatagtgcttttctccctcaaagtatttttctagccttgaattcattttatcttcattatccctgtgaagtaggtgggacaagtataaggggaagaggggtgctgaatttttaggccaaagactgatattaatacaaatcactcactaactgtagagccttgggcattatcagtgaactactctgagatttactgtcttcatctgtttaatgagtagaatgtccgtgatgcctacctcacagggttgttgtgagggtcaaatgagaatgtatgtgaaagatttgtaaatggtaaagcactatattcttgtttgttagtcctttttcctttctttgggtagacctacagtcagatgttttgttttatggatcacttattttccttactggtagactgtcgttttatagacatattcctatttcatatattctctccctgttgttagagaacctatctttgtttttggtcaaaacacacatagaaaacaaaatgatccaatgaaaactggtttaactagcaaaagccttggcacctgttggagactatgaccaagccaataaaaagggcatttaaatcagccctgttagtaggaatgtggctatggctggtgcctcttctagtcacaagtttgtttttggagggggtccagaagatcattcccttgcatagatttctcttttaccaatttgagtgcctcctacatgggcagcagtggactaagtgctgggtgtgataaagaggaatgacttaattatgagactgtatataatcaaatacagtgtgggttaggacctgtggcagaccattataataaagcatggccccgtgagggttttgaaagaga

SEQ ID NO: 6245 - DNA, 2553 bp, Homo sapiens
agaatcccgcgctgaagcgaagtcgagacgtttgaccttcctccgtttccgtagttccgagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacagagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 6246 - DNA, 2417 bp, Homo sapiens
agaatcccgcgctgaagcgaagtcgagacgtttgaccttcctccgtttccgtagttccgagttgcggtttctccgttagtgcttccgggttgcagccagggaagcctccgcggtggtgcaagtggaacccaagccttgaggtttcatttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacagagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 6247 - DNA, 2290 bp, Homo sapiens
agaatcccgcgctgaagcgaagtcgagacgtttgaccttcctccgtttccgtagttccgagttgcggtttctccgttagtgcttccgggttgcagccagggaagcctccgcggtggtgcaagtggaacccaagccttgaggtttcatttccccctcccaggatttcgactcagttcagcgaagtcaccgccccgtctgagaaatgaggacaccaaggcttagagcacagccccgaggcgccgtctaccaggccccgtcccctcccccggctcctgtcggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacagagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctg

SEQ ID NO: 6248 - DNA, 1179 bp, Homo sapiens
agtgcttccgggttgcagccagggaagcctccgcggtggtgcaagtggaacccaagccttgaggtttcagcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacagagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctg

SEQ ID NO: 6249 - DNA, 1840 bp, Homo sapiens
agaatcccgcgctgaagcgaagtcgagacgtttgaccttcctccgtttccgtagttccgagttgcggtttctccgttagtgcttccgggttgcagccagggaagcctccgcggtggtgcaagtggaacccaagccttgaggtttcatccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacagagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 6250 - DNA, 1976 bp, Homo sapiens
agtgcttccgggttgcagccagggaagcctccgcggtggtgcaagtggaacccaagccttgaggtttcatttccccctcccaggatttcgactcagttcagcgaagtcaccgccccgtctgagaaatgaggacaccaaggcttagagcacagccccgaggcgccgtctaccaggccccgtcccctcccccggctcctgtcggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacagagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatggggg

SEQ ID NO: 6251 - DNA, 1843 bp, Homo sapiens
gtggaagccgccgccgcgctcgcagcttgcaggcgccgcgtagccgtcgccaccgccgccagcccgtgcgccctcggcgcgtacccgccgcgctcccatccccgccgccggccaggggcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaaaagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctggaccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcctaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgtaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaaca

SEQ ID NO: 6252 - DNA, 2397 bp, Homo sapiens
gggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaa

SEQ ID NO: 6253 - DNA, 2131 bp, Homo sapiens
agattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacagatataacattggagaagtatctctttgtaatgctaaaaagaagtgaaaatcaacagacttatctaatgaatgcagatgtggcagaaagaatgagtagcactaccgttgactctgaagagagacttcttagaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagcaacattcgttctctaaccattctgtattgattatataagcaaaatgaaaagagaaacttaaatgaacacagctctttaacatggttcaggtacacatattttgacccaagtggatattttcttaaaaccaatcaataatagctagctattactgcagactataaaatctggatatagaaaggagacctgtatcaaactgcttttgtagtgtgttttcataacaacttatgactaaaaatatcacactgaataagagagcaggattgccaggtatttttctatttctctccttaattttatatgtatatagatatatttggcttatattctaagtcacctaagtacttaaaagttaagttggtaaagtatttactgactgcttataaacatttaaagacaaagacatttcaaataactgcagaaaaaatattgtagtttgaatatttaagcaataaaactgctagtgagttattgt

SEQ ID NO: 6254 - DNA, 2536 bp, Homo sapiens
gcactcgggcgcagccgggtggatctcgagcaggtgtgagcagcctatcagtcaccatgtccgcagcctggatcccggctctcggcctcggtgtgtgtctgctgctgctgccggggcccgcgggcagcgagggagccgctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagcaacattcgttctctaaccattctgtattgattatataagcaaaatgaaaagagaaacttaaatgaacacagctctttaacatggttcaggtacacatattttgacccaagtggatattttcttaaaaccaatcaataatagctagctattactgcagactataaaatctggatatagaaaggagacctgtatcaaactgcttttgtagtgtgttttcataacaacttatgactaaaaatatcacactgaataagagagcaggattgccaggtatttttctatttctctccttaattttatatgtatatagatatatttggcttatattctaagtcacctaagtacttaaaagttaagttggtaaagtatttactgactgcttataaacatttaaagacaaagacatttcaaataactgcagaaaaaatattgtagtttgaatatttaagcaataaaactgctagtgagttattgtaa

SEQ ID NO: 6255 - DNA, 2687 bp, Homo sapiens
gacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgggtgcgcgcccctcacgaccccggccccttgctccgctgggtggaggctggagccagccctcacgcttctctcttcgcagctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggggagtaatcagcaactcagggggacctgtacgagtctatagcctacctggtcgagaaaactattcctcagtagatgccaatggcatccagtctcaaatgctttctagatggtctgcttctttcacagtaactaaaggcaaaagtagtacacaggaggccacaggacaagcagtgtccacagcacatccaccaacaggtaaacgactaaagaaaacacccgagaagaaaactggcaataaagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccagtgaacatcccaaaatagaattttacttgaaaaactttacatcagccaaagatgttttgtttgccataaaggaagtaggtttcagagggggtaattccaatacaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggctgtctgtcggaataatggcttcttctcttaccacatgcccaactggtttggcaccacaaaatacgtaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagcaacattcgttctctaaccattctgtattgattatataagcaaaatgaaaagagaaacttaaatgaacacagctctttaacatggttcaggtacacatattttgacccaagtggatattttcttaaaaccaatcaataatagctagctattactgcagactataaaatctggatatagaaaggagacctgtatcaaactgcttttgtagtgtgttttcataacaacttatgactaaaaatatcacactgaataagagagcaggattgccaggtatttttctatttctctccttaattttatatgtatatagatatatttggcttatattctaagtcacctaagtacttaaaagttaagttggtaaagtatttactgactgcttataaacatttaaagacaaagacatttcaaataactgcagaaaaaatattgtagtttgaatatttaagcaataaaactgctagtgagttattgt

SEQ ID NO: 6256 - DNA, 3821 bp, Homo sapiens
agagactctcactgcacgccggagggcgcccttcctcgctcgcgcccgcgcgaccgcgcgccccagtcccgccccgccccgctaaccgccccagacacagcgctcgccgagggtcgcttggaccctgatcttacccgtgggcaccctgcgctctgcctgccgcgaagaccggctccccgacccgcagaagtcaggagagagggtgaagcggagcagcccgaggcggggcagcctcccggagcagcgccgcgcagagcccgggacaatggggccgcggcggctgctgctggtggccgcctgcttcagtctgtgcggcccgctgttgtctgcccgcacccgggcccgcaggccagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctgctcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatcatttccacggtctgttatgtgtctatcattcgatgtcttagctcttccgcagttgccaaccgcagcaagaagtcccgggctttgttcctgtcagctgctgttttctgcatcttcatcatttgcttcggacccacaaacgtcctcctgattgcgcattactcattcctttctcacacttccaccacagaggctgcctactttgcctacctcctctgtgtctgtgtcagcagcataagctgctgcatcgaccccctaatttactattacgcttcctctgagtgccagaggtacgtctacagtatcttatgctgcaaagaaagttccgatcccagcagttataacagcagtgggcagttgatggcaagtaaaatggatacctgctctagtaacctgaataacagcatatacaaaaagctgttaacttaggaaaagggactgctgggaggttaaaaagaaaagtttataaaagtgaataacctgaggattctattagtccccacccaaactttattgattcacctcctaaaacaacagatgtacgacttgcatacctgctttttatgggagctgtcaagcatgtatttttgtcaattaccagaaagataacaggacgagatgacggtgttattccaagggaatattgccaatgctacagtaataaatgaatgtcacttctggatatagctaggtgacatatacatacttacatgtgtgtatatgtagatgtatgcacacacatatattatttgcagtgcagtatagaataggcactttaaaacactctttccccgcaccccagcaattatgaaaataatctctgattccctgatttaatatgcaaagtctaggttggtagagtttagccctgaacatttcatggtgttcatcaacagtgagagactccatagtttgggcttgtaccacttttgcaaataagtgtattttgaaattgtttgacggcaaggtttaagttattaagaggtaagacttagtactatctgtgcgtagaagttctagtgttttcaattttaaacatatccaagtttgaattcctaaaattatggaaacagatgaaaagcctctgttttgatatgggtagtattttttacattttacacactgtacacataagccaaaactgagcataagtcctctagtgaatgtaggctggctttcagagtaggctattcctgagagctgcatgtgtccgcccccgatggaggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttaaaaacaacgaaagaaggcatggacttctggatgcccatccactgggtgtaaacacatctagtagttgttctgaaatgtcagttctgatatggaagcacccattatgcgctgtggccactccaataggtgctgagtgtacagagtggaataagacagagacctgccctcaagagcaaagtagatcatgcatagagtgtgatgtatgtgtaataaatatgtttcacacaaacaaggcctgtcagctaaagaagtttgaacatttgggttactatttcttgtggttataacttaatgaaaacaatgcagtacaggacatatattttttaaaataagtctgatttaattgggcactatttatttacaaatgttttgctcaatagattgctcaaatcaggttttcttttaagaatcaatcatgtcagtctgcttagaaataacagaagaaaatagaattgacattgaaatctaggaaaattattctataatttccatttacttaagacttaatgagactttaaaagcattttttaacctcctaagtatcaagtatagaaaatcttcatggaattcacaaagtaatttggaaattaggttgaaacatatctcttatcttacgaaaaaatggtagcattttaaacaaaatagaaagttgcaaggcaaatgtttatttaaaagagcaggccaggcgcggtggctcacgcctgtaatcccagcactttgggaggctgaggcgggtggatcacgaggtcaggagatcgagaccatcctggctaacacggtgaaacccgtctctactaaaaatgcaaaaaaaattagccgggcgtggtggcaggcacctgtagtcccagctactcgggaggctgaggcaggagactggcgtgaacccaggaggcggaccttgtagtgagccgagatcgcgccactgtgctccagcctgggcaacagagcaagactccatctcaaaaaataaaaataaataaaaaataaaaaaataaaagagcaaactatttccaaataccatagaataacttacataaaagtaatataactgtattgtaagtagaagctagcactggttttattaatttagtgactattcattttatctaaatcagtgaagatttactgtcattgtttattagtctgtatatattaaaatatgatatcattaatgtacttacaaaatagtatgtcactgtttttatgttcattcttaaaaacataacctgtattaataaatgtgaacatttgcttggtatctctttggaa

SEQ ID NO: 6257 - DNA, 2914 bp, Homo sapiens
ggtcccggggcgtggcctcccgcaggtgagtacgctgctccttcggtttccctgaaacctaacccgccctggggaggcgcgcagcagaggctccgattcggggcaggtgagaggctgactttctctcggtgcgtccagtggagctctgagtttcgaatcggcggcggcggattccccgcgcgcccggcgtcggggcttccaggaggatgcggagccccagcgcggcgtggctgctgggggccgccatcctgctagcagcctctctctcctgcagtggcaccatccaaggaaccagtagatcctctaaaggaagaagccttattggtaaggttgatggcacatcccacgtcactggaaaaggagttacagttgaaacagtcttttctgtggatgagttttctgcatctgtcctcactggaaaactgaccactgtcttccttccaattgtctacacaattgtgtttgtggtgggtttgccaagtaacggcatggccctgtgggtctttcttttccgaactaagaagaagcaccctgctgtgatttacatggccaatctggccttggctgacctcctctctgtcatctggttccccttgaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccattcctttgtatgtcgtgaagcagaccatcttcattcctgccctgaacatcacgacctgtcatgatgttttgcctgagcagctcttggtgggagacatgttcaattacttcctctctctggccattggggtctttctgttcccagccttcctcacagcctctgcctatgtgctgatgatcagaatgctgcgatcttctgccatggatgaaaactcagagaagaaaaggaagagggccatcaaactcattgtcactgtcctggccatgtacctgatctgcttcactcctagtaaccttctgcttgtggtgcattattttctgattaagagccagggccagagccatgtctatgccctgtacattgtagccctctgcctctctacccttaacagctgcatcgacccctttgtctattactttgtttcacatgatttcagggatcatgcaaagaacgctctcctttgccgaagtgtccgcactgtaaagcagatgcaagtatccctcacctcaaagaaacactccaggaaatccagctcttactcttcaagttcaaccactgttaagacctcctattgagttttccaggtcctcagatgggaattgcacagtaggatgtggaacctgtttaatgttatgaggacgtgtctgttatttcctaatcaaaaaggtctcaccacataccatgtggatgcagcacctctcaggattgctaggagctcccctgtttgcatgagaaaagtagtcccccaaattaacatcagtgtctgtttcagaatctctctactcagatgaccccagaaactgaaccaacagaagcagacttttcagaagatggtgaagacagaaacccagtaacttgcaaaaagtagacttggtgtgaagactcacttctcagctgaaattatatatatacacatatatatattttacatctgggatcatgatagacttgttagggcttcaaggccctcagagatgatcagtccaactgaacgaccttacaaatgaggaaaccaagataaatgagctgccagaatcaggtttccaatcaacagcagtgagttgggattggacagtagaatttcaatgtccagtgagtgaggttcttgtaccacttcatcaaaatcatggatcttggctgggtgcggtgcctcatgcctgtaatcctagcactttgggaggctgaggcaggcaatcacttgaggtcaggagttcgagaccagcctggccatcatggcgaaacctcatctctactaaaaatacaaaagttaaccaggtgtgtggtgcacgtttgtaatcccagttactcaggaggctgaggcacaagaattgagtatcactttaactcaggaggcagaggttgcagtgagccgagattgcaccactgcactccagcttgggtgataaaataaaataaaatagtcgtgaatcttgttcaaaatgcagattcctcagattcaataatgagagctcagactgggaacagggcccaggaatctgtgtggtacaaacctgcatggtgtttatgcacacagagatttgagaaccattgttctgaatgctgcttccatttgacaaagtgccgtgataatttttgaaaagagaagcaaacaatggtgtctcttttatgttcagcttataatgaaatctgtttgttgacttattaggactttgaattatttctttattaaccctctgagtttttgtatgtattattattaaagaaaaatgcaatcaggattttaaacatgtaaatacaaattttgtataacttttgatgacttcagtgaaattttcaggtagtctgagtaatagattgttttgccacttagaatagcatttgccacttagtattttaaaaaataattgttggagtatttattgtcagttttgttcacttgttatctaatacaaaattataaagccttcagagggtttggaccacatctctttggaaaatagtttgcaacatatttaagagatacttgatgccaaaatgactttatacaacgattgtatttgtgacttttaaaaataattattttattgtgtaattgatttataaataacaaaattttttttacaactta

SEQ ID NO: 6258 - DNA, 3408 bp, Homo sapiens
atgcttactgaagcatcgagtggattacatcctttccctgcggaggaccagggcaagtttcctgcctgcacggcacaggagagcaaacttctacagacagaccaaggcttccatttgctgctgacacatggaactgaggtgaaattgtgctccatgattttacagatttcataacgtttaagagacgggactcaggtcatcaaaatgaaagccctcatctttgcagctgctggcctcctgcttctgttgcccactttttgtcagagtggcatggaaaatgatacaaacaacttggcaaagccaaccttacccattaagacctttcgtggagctcccccaaattcttttgaagagttccccttttctgccttggaaggctggacaggagccacgattactgtaaaaattaagtgccctgaagaaagtgcttcacatctccatgtgaaaaatgctaccatggggtacctgaccagctccttaagtactaaactgatacctgccatctacctcctggtgtttgtagttggtgtcccggccaatgctgtgaccctgtggatgcttttcttcaggaccagatccatctgtaccactgtattctacaccaacctggccattgcagattttcttttttgtgttacattgccctttaagatagcttatcatctcaatgggaacaactgggtatttggagaggtcctgtgccgggccaccacagtcatcttctatggcaacatgtactgctccattctgctccttgcctgcatcagcatcaaccgctacctggccatcgtccatcctttcacctaccggggcctgcccaagcacacctatgccttggtaacatgtggactggtgtgggcaacagttttcttatatatgctgccatttttcatactgaagcaggaatattatcttgttcagccagacatcaccacctgccatgatgttcacaacacttgcgagtcctcatctcccttccaactctattacttcatctccttggcattctttggattcttaattccatttgtgcttatcatctactgctatgcagccatcatccggacacttaatgcatacgatcatagatggttgtggtatgttaaggcgagtctcctcatccttgtgatttttaccatttgctttgctccaagcaatattattcttattattcaccatgctaactactactacaacaacactgatggcttatattttatatatctcatagctttgtgcctgggtagtcttaatagttgcttagatccattcctttattttctcatgtcaaaaaccagaaatcactccactgcttaccttacaaaatagtgaaatgatcttagagaacaaggacagccatcacagagaacgtctgttttcaagaacaacataagcatagtgcaaggagctccatttccgagctcctaagaaatatgcttcaaaggtcaaacattacaaaagcattagtagtttgtttgtttgtttttgagactgagtctcactttatcacccagactggcgtgcagtggcactatcttggctcattgcaacctctgcctcccaggtcagcctcccaagtagctgggattacaccaccatgcccagctactaaaaatacttgtatttttagtagagacggggtttcaccatgttgaccaggctggtcttgaactcctgacctcaagtgatcttccggcctcagcctcccaaagtgctggattacaggcgtgagccactgagccagccagcattagtaatttttaaaaacactttatcagtattttaaaaatgttaatgcaggagaaaagatatcacaactctatggaaaatgacatttccatttgccttattgctacttcaagctctttaaatcaccatcttccctatttctgtgagtggtattgccatccttgacatttgacatcattttttattctttggtctcttttgactctcatgctggtggctgcctcatcaactgattctatctttgtagggtccctcaccagggtcttttatctagtttcacctttgccttcttttttcctttttttaatagagacagtgtctcgcttcgtcacctggctgaagtgcagtagcctgatcatagctcacttcagcctccaactcctgggctcaagcaatcctgctgtctcagcctcccaagtaactaagactacaggcatgcaccaccatacccaactaattttattttttattttttgcagagatggagtctcactgttgcccaggctggtcttgaactcctggtctcgagtgatcttcctatctcagcctcccaaagtgctgggactacaggcatgagccactacgtccaggccacctctaccttctaaccattctctccactgccagcctaccctccaccacttcacaagtcctgccagattaatcttccttagatatcagttaggatacatcactaaaacatttccactaactccactgtttctataataaatcataaatctttagcctggcattcaaggctaacttgctaatcacacttcccattaaaccttgcttatgatataggcaccaaccaaacctcttgctctgctatatctccactctgcctcagactgaaaagctagtcctaacgtctttgccttaattctgttcattttttcaagtccttgaaggaccattcttccctgattctcaggctagaagtgtcacttttcttatctgtacttccaaagcactttcgtatatttttattatggcatttatatatagttcatttatatttaaattttaattccatgaacaatcaagtaccaagtataatggagaaggtgctcatcctctgccttccttgagcttctgggtgatgccaggcccaagtctttgtggcacccagctccatgctttgaatactatgtggctgaatgaatttttaaaatctcaaagcagttaaacagcaggaaagcccattaacttcgtactgaaaaagcaacatactgtgatgatacgggatgacatcatttcaggttgggcatacaaaaaagtaaggaagctaaactaagactatactcaccaggccatttagaagttttaaataatgcctccactattttttttcttagacatagcttttaatggggaaatggaattttgttattaatacccattatattcctgtaagtaaatgactatttttcccttaactcagtgattagacaggaaggaagacattagtgattagacaggagggaagatattagtgattagacagcagggaagatattagtggtaaagagtgaatgatagtagtgaatataaatggggctgaggaaactttaagcataaaagattcctgagatgactttacaagtctgtacgaatctgccttgactgtatatttcatactgcccaacaaaacaa

SEQ ID NO: 6259 - DNA, 1387 bp, Homo sapiens
ggattacatcctttccctgcggaggaccagggcaagtttcctgcctgcacggcacaggagagcaaacttctacagacagaccaaggcttccatttgctgctgacacatggaactgaggcatggaaaatgatacaaacaacttggcaaagccaaccttacccattaagacctttcgtggagctcccccaaattcttttgaagagttccccttttctgccttggaaggctggacaggagccacgattactgtaaaaattaagtgccctgaagaaagtgcttcacatctccatgtgaaaaatgctaccatggggtacctgaccagctccttaagtactaaactgatacctgccatctacctcctggtgtttgtagttggtgtcccggccaatgctgtgaccctgtggatgcttttcttcaggaccagatccatctgtaccactgtattctacaccaacctggccattgcagattttcttttttgtgttacattgccctttaagatagcttatcatctcaatgggaacaactgggtatttggagaggtcctgtgccgggccaccacagtcatcttctatggcaacatgtactgctccattctgctccttgcctgcatcagcatcaaccgctacctggccatcgtccatcctttcacctaccggggcctgcccaagcacacctatgccttggtaacatgtggactggtgtgggcaacagttttcttatatatgctgccatttttcatactgaagcaggaatattatcttgttcagccagacatcaccacctgccatgatgttcacaacacttgcgagtcctcatctcccttccaactctattacttcatctccttggcattctttggattcttaattccatttgtgcttatcatctactgctatgcagccatcatccggacacttaatgcatacgatcatagatggttgtggtatgttaaggcgagtctcctcatccttgtgatttttaccatttgctttgctccaagcaatattattcttattattcaccatgctaactactactacaacaacactgatggcttatattttatatatctcatagctttgtgcctgggtagtcttaatagttgcttagatccattcctttattttctcatgtcaaaaaccagaaatcactccactgcttaccttacaaaatagtgaaatgatcttagagaacaaggacagccatcacagagaacgtctgttttcaagaacaacataagcatagtgcaaggagctccatttccgagctcctaagaaatatgcttcaaaggtcaaacattacaaaagcattagtagtttgtttgtttgtttttgagactgagtctcactttatcacccagactggcgtgcagtggcactatctt

SEQ ID NO: 6260 - DNA, 2731 bp, Homo sapiens
ctcccacgggctggctggcaagcggccctggtgggtctgcgggggcaggggcagccttcctggtttatctctaccggcgcgatctgctcgtccgcctcggctccagaagctggggctcagggtccggcgaggcaggaagcctgaggccacagcccagagcagcctgagtgcagtcatgtgggggcgactgctcctgtggcccctggtgctggggttcagcctgtctggcggcacccagacccccagcgtctacgacgagagcgggagcaccggaggtggtgatgacagcacgccctcaatcctgcctgccccccgcggctacccaggccaagtctgtgccaatgacagtgacaccctggagctcccggacagctcacgggcactgcttctgggctgggtgcccaccaggctggtgcccgccctctatgggctggtcctggtggtggggctgccggccaatgggctggcgctgtgggtgctggccacgcaggcacctcggctgccctccaccatgctgctgatgaacctcgcggctgctgacctcctgctggccctggcgctgcccccgcggatcgcctaccacctgcgtggccagcgctggcccttcggggaggccgcctgccgcctggccacggccgcactctatggtcacatgtatggctcagtgctgctgctggccgccgtcagcctggatcgctacctggccctggtgcacccgctgcgggcccgcgccctgcgtggccggcgcctggcccttggactctgcatggctgcttggctcatggcggccgccctggcactgcccctgacactgcagcggcagaccttccggctggcgcgctccgatcgcgtgctctgccatgacgcgctgcccctggacgcacaggcctcccactggcaaccggccttcacctgcctggcgctgttgggctgtttcctgcccctgctggccatgctgctgtgctacggggccaccctgcacacgctggcggccagcggccggcgctacggccacgcgctgaggctgaccgcagtggtgctggcctccgccgtggccttcttcgtgcccagcaacctgctgctgctgctgcattactcggacccgagccccagcgcctggggcaacctctatggtgcctacgtgcccagcctggcgctgagcaccctcaacagctgcgtggatcccttcatctactactacgtgtcggccgagttcagggacaaggtgcgggcagggctcttccaacggtcgccgggggacaccgtggcctccaaggcctctgcggaagggggcagccggggcatgggcacccactcctctttgctccagtgacacaaagtggggaaggctgtactgggtcgaacagggtcccttcccccacttcacgtccttcctgggacctcagaatgtgaccttatttggaaatagggttgttacaactgtcactagcggaggtcactttggagaagggtgggccttacatccagtgtgggtggtgtcctcataagataaggagaggccaggcctggtggctcacgcctgtaatcccagcactttaagaggccaaggcggatggatcacttgagcccaggagttcaacaccagcctgagcaacatggtaaaaccccatctctaccaaaaatacaaaaattagctgggcttggtggctggcgcctgtaatcccagctactcaggagactgaggcagaaggatcgcttgaacctgggaggcagaggttgcagtgagccgagattgcgccactggactccagcctgcgtgacagagagcctgtctctaaattaattaattaattaatttaattcaattttaaaaagacgaaaagtgacggccaggtgcagtggctcacgcctataatctcagcactctgggaggccaagatggaggattgcttgaagccaggagtttgggaccagcctgggcaacatagggggatcccatctctacacacaaaaaaattttttaatgaaccaggcattgtggcatgcgcctatagtcccagccactcaagaggcacaggcgggaggatcacttgagcctgggaggttgtggttgcagtgagctatgattgtaccactgcactccagcctgggcaacagagcaagaccttgtctcaaaaataaacaaactaaaattaaaaaaagaagacgagagatagtgggtgtggtggctcacacctgcaatcccagcactttggaaggccgaggtgggcagatcatctgaggccaggagttcaagaccagcctggctaacatggtgaaatcctatctctaccaaaaatacaaaaattagccaggcgtggtggtgggcacctgtactggggaggtgcccacccagctactggggaggctgagtcaggagaatcgcttgaacctgggaggcggaggttgcggtcagctgagatggtgccactgcactccagcctgggcgaaagagcgactctgtctccaaaaaaaagagaagaggagaggacacagagacacacagagaagaaagccatgtggcggcagaggcagagatgggagtgatgcggacggacacaaactaagggatgccacgatgccaagcacagccaacagccaccagcagccaggagacaggcctgggacgggctctccctcacagcctccagagggaaccagccctgccaccaccttgaccctggacttctggcctgcagaactgtgagacaataaactctcattgttttaa

SEQ ID NO: 6261 - DNA, 2049 bp, Homo sapiens
ctattgatctggactcctggataggcagctggaccaacggacggatgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggagccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgag

SEQ ID NO: 6262 - DNA, 2217 bp, Homo sapiens
agtgcttagaattgttaaaatctttgtgaagcacaccactgaagatgaggttgaaaaacctgacttttatcatcatattgataatctcaggagaactctatgcagaagagaaaccctgtggttttcctcatgtggaaaatggaagaattgcccaatattactatacttttaaaagcttttactttccaatgagcatagacaaaaaattgtcatttttctgcttggctggttataccactgaaagtggaagacaagaagagcaaaccacgtgtacaacagaaggctggtctccagagccaaggtgcttcaaaaaatgcactaagcctgacctgagtaatggttacatctctgatgtaaagttattgtataaaattcaagagaacatgcgttatggttgcgcttcagggtacaaaaccactggagggaaggatgaagaagtggttcaatgtctctctgatggatggtcttctcaaccaacctgtaggaaagaacatgaaacatgtttggctcctgaattatataatggaaattattccacaacacagaaaacattcaaagtgaaggacaaagtacaatacgaatgtgctactggctactacacagctggaggaaagaagacagaggaggtagaatgtctcacatacggatggtctctcacaccaaaatgtaccaaattaaagtgctcttctttaagattaattgaaaatggttattttcatcctgtaaagcaaacctatgaagaaggagatgtcgttcagtttttctgtcatgaaaattattatctaagtggatctgatttaattcaatgctataactttggttggtacccagaatctcctgtatgcgaaggaagaagaaacagatgtcctcctccacctctgcccataaactccaaaattcaaacacattcaacaacttatcgtcatggagaaatagttcatatagaatgtgaacttaattttgagatccatgggtcagcagaaatacgttgtgaagatggaaaatggacagaacctccaaaatgcattgaaggacaggagaaggtagcctgtgaggaaccacccttcattgaaaatggtgcagcaaatttacactctaagatttattacaatggggataaagtgacatatgcatgtaaaagcggctaccttctccatggatcgaatgagataacttgtaatcgtggaaaatggacacttcctcctgagtgtgttgaaaataatgagaattgtaagcatcctcctgttgtaatgaatggggctgttgcagacgggatattggcaagctatgcaacaggatcctcagtggaatatagatgcaatgaatattacttactgaggggatcaaaaatatctcgttgcgaacaaggaaaatggtcatccccacctgtttgcttggaaccatgtactgttaatgtggattacatgaacagaaataacatagaaatgaagtggaaatatgaagggaaagtcttacatggagatttaatagattttgtatgtaaacagggatatgacttatctccattaaccccattgtctgaattatctgtgcagtgcaacagaggagaagtgaaatatcctttatgtactagaaaagaatctaaaggaatgtgcacatctcctcctcttattaaacatggagtcattattagttcaacagtagacacctatgaaaatggctcttcagtagaatacagatgttttgatcaccatttcctagaaggatctagggaggcctattgtttagatggaatgtggactacaccaccattgtgtttagagccatgcacattatcttttactgaaatggaaaagaataatttacttctgaaatgggattttgacaatagaccacacattttgcatggtgaatatattgagtttatttgtagaggagatacttatccagctgaattatatattactggatctatacttagaatgcaatgtgacagagggcagttaaaatatccaagatgtattccaagacaaagcactctgtcttatcaagaacccttaagaacatagaaatgaatggcagaaagaggagtcatatttcaatacatcatgaaattccttataaaatataattttgaggaaataagttaaaaacttcggagtttttccttgcttaaatatttgaatctaaattatttgtgctgaacatttcgttatttataaatgaaaaccaataaatgtctaatttttagtttgt

SEQ ID NO: 6263 - DNA, 4789 bp, Homo sapiens
ccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttcttga

SEQ ID NO: 6264 - DNA, 4664 bp, Homo sapiens
cgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaactggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgaacactcatgccctttgcctcttacagccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttcttga

SEQ ID NO: 6265 - DNA, 3481 bp, Homo sapiens
agccaaggactctggagccgccgccgccgctgctgcggttcatagccggagtagacggagccgcagtagacggatccgcggctgcaccaaaccactgcccctcggagcctggtagtgggccacaagcccccagtcccagaggcgtggtgggtcgggcagagtcggaagaactggctttctagctggaagatgcggaaggggagcgactaggccgcttgcgtctgggcctggcagaagggaccggattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttata

SEQ ID NO: 6266 - DNA, 3382 bp, Homo sapiens
aggtggctgtggcttcggtcgttaccccacccccttccacgtcagccaaggactctggagccgccgccgccgctgctgcggttcatagccggagtagacggagccgcagtagacggatccgcggctgcaccaaaccactgcccctcggagcctggtagtgggccacaagcccccagtcccagaggcgtgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaa

SEQ ID NO: 6267 - DNA, 3175 bp, Homo sapiens
ggaaacgacggccctgcgcgcagtttgcgcaggcgctccggccctggcctctgactatcgcgagaatcggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaa

SEQ ID NO: 6268 - DNA, 3034 bp, Homo sapiens
atcgcgagaatcggctcccggaagttccacgtcagtcagtctgacgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaatt

SEQ ID NO: 6269 - DNA, 1134 bp, Homo sapiens
gacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 6270 - DNA, 978 bp, Homo sapiens
gacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 6271 - DNA, 981 bp, Homo sapiens
gacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctga

SEQ ID NO: 6272 - DNA, 1128 bp, Homo sapiens
cgtgtctttcaggaagaggagctggtgagaagacagcgaaatggcgcctccggccccggccggcctccggggctccggggaggtagacgagctgttcgacgtaaagaacgccttctacatcggcagctaccagcagtgcataaacgaggcgcagcgggtgaagctatcaagcccagagagagacgtggagagggacgtcttcctgtatagagcgtacctggcgcagaggaagttcggtgtggtcctggatgagatcaagccctcctcggcccctgagctccaggccgtgcgcatgtttgctgactacctcgcccacgagagtcggagggacagcatcgtggccgagctggaccgagagatgagcaggagcgtggacgtgaccaacaccaccttcctgctcatggccgcctccatctatctccacgaccagaacccggatgccgccctgcgtgcgctgcaccagggggacagcctggagtgcacagccatgacagtgcagatcctgctgaagctggaccgcctggacctcgcccggaaggagctgaagagaatgcaggacctggacgaggatgccaccctcacccagctcgccactgcctgggtcagcctggccacgggtggtgagaagctgcaggatgcctactacatcttccaggagatggctgacaagtgctcgcccaccctgctgctgctcaatgggcaggcggcctgccacatggcccagggccgctgggaggccgctgagggcctgctgcaggaggcgctagacaaggatagtggctacccagagacgctggtcaacctcatcgtcctgtcccagcacctgggcaagccccctgaggtgacaaaccgatacctgtcccagctgaaggatgcccacaggtcccatcccttcatcaaggagtaccaggccaaggagaacgactttgacaggctggtgctacagtacgctcccagcgcctgaggctggcccagagctgtcaggaccatgaagccaggacagaggccaggagccagccctgcagccctccccacccggcatccacctgcatcccctctgggggcaggagcccacccccagcacccccatctgttaataaatatctcaactccagggtgttccacctg

SEQ ID NO: 6273 - DNA, 792 bp, Homo sapiens
ggctgcggcgcctgggacggttgcggtgggtctgggcgctgggaagtcgtccaagatgattaaaaaattcgacaagaaggacgaggagtctggtagtggctccaatcctttccagcatctggagaagagtgctgttttacaggaggctcgtatattcaatgaaactccaatcaatccaagaagatgtttgcatattcttacaaagattctttacttactgaaccagggtgaacactttggaacaacggaagctacagaagccttctttgcaatgacgcgattgtttcaatctaatgatcaaacattgaggagaatgtgctaccttaccatcaaagaaatggctaccatctctgaggatgtgataattgtcacaagcagtctgactaaagacatgactggaaaagaagatgtataccgaggcccggccatcagagctctctgcaggatcaccgatggaacaatgttgcaagccattgaaagatacatgaagcaggccattgtggataaagtttccagtgtatccagttcagcactggtatcttccctgcacatgatgaagataagctatgatgtggttaagcgctggatcaatgaagcccaagaagctgcatcaagtgataatattatggtccagtaccatgcattgggagtcctgtatcaccttagaaagaatgatcgacttgctgtttccaagatgttgaataagtttactaaatctggtctcaagtcacagtttgcttactgcatgctgatccgaattgccagtcgcttactaaaagaaactgaggatgg

SEQ ID NO: 6274 - DNA, 895 bp, Homo sapiens
ttgcaggctcctttagctgcaccatgaagtttacagtccgggactgtgaccctaacactggagttccagatgaggatgggtatgatgatgagtatgtgctggaagatctcgaagtgactgtgtctgaccatattcagaaagtactgaagcctaactttgctgctgcttgggaagaggtgggagatacctttgagaaagaggaaacctttgccctcagttctaccaaaacccttgaagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcaagcaaatgtctatctttgcgcatgggttgtttttttttttttttctttttattctacttggtcagctttgggacgatagtgcagctttgggtgatcttgaaaatcaaatactatcctatactccagctgcttaacttcattttattctttaatgtgtacctgaaagctcctggcaatgctggaaaatttttatcccagaggggtgggggggaggggggaggggaagccagagtccacttttgtcacaattcatttttattaatagaaaataaacacttattc

SEQ ID NO: 6275 - DNA, 831 bp, Homo sapiens
cggggccggccttcctgcagcctcttccgctcgccggctgcggcgcctgggacggttgcggtgggtctgggcgctgggaagtcgtccaagatgattaaaaaattcgacaagaaggacgaggagtctggtagtggctccaatcctttccagcatctggagaagagtgctgttttacaggaggctcgtatattcaatgaaactccaatcaatccaagaagatgtttgcatattcttacaaagattctttacttactgaaccagggtgaacactttggaacaacggaagctacagaagccttctttgcaatgacgcgattgtttcaatctaatgatcaaacattgaggagaatgtgctaccttaccatcaaagaaatggctaccatctctgaggatgtgataattgtcacaagcagtctgactaaagacatgactggaaaagaagatgtataccgaggcccggccatcagagctctctgcaggatcaccgatggaacaatgttgcaagccattgaaagatacatgaagcaggccattgtggataaagtttccagtgtatccagttcagcactggtatcttccctgcacatgatgaagataagctatgatgtggttaagcgctggatcaatgaagcccaagaagctgcatcaagtgataatattatggtccagtaccatgcattgggagtcctgtatcaccttagaaagaatgatcgacttgctgtttccaagatgttgaataagtttactaaatctggtctcaagtcacagtttgcttactgcatgctgatccgaattgccagtcgcttactaaaagaaactgaggatgggtaa

SEQ ID NO: 6276 - DNA, 1402 bp, Homo sapiens
gcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttagttattcagaggctgctctgctgagaagatgaacaaatttcttgtccaaaacaatgtatttcaaacgtgccgctcgggcctttcccgtattgctcactggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactagacaagttgctttggcagatgccattctcattaataaaacagacctggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggt

SEQ ID NO: 6277 - DNA, 1703 bp, Homo sapiens
ccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactagacaagttgctttggcagatgccattctcattaataaaacagacctggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacagttatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttat

SEQ ID NO: 6278 - DNA, 721 bp, Homo sapiens
aaggggcgaggcgcttctcgtccagagcccaggtaatccgggcgggatcagcgagcgtcgcgatgtgatgacgtcaggccccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaagtgaaataccactaa

SEQ ID NO: 6279 - DNA, 1572 bp, Homo sapiens
aggccccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacagttatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgtta

SEQ ID NO: 6280 - DNA, 1793 bp, Homo sapiens
gtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactagacaagttgctttggcagatgccattctcattaataaaacagacctggttccagaagaagatgtaaagaaattaagaacgacaattaggtacgaaatgataagtgtgttaagtgcctacagatccatgttgtatacacagaatattttttactctgattgttgccctgtagaaacttaaggtataaggttgagctgcttcaagaacgttagggaatcacatatattgttgatggctaattgttatataaatggtaatacataaaattagtccccagtgcttgcagaatatagttcacagttaatagactgatattcagggtcttcgcactccatctttcttttcctgtcttctctttgactctttcctaatgtcagtcttccctaactttacccaggatggttaattcactttcccatggatgcatcctgtcagttcctgtctttactcgtaatgtattctcactctgccaatccctgagttctttcttgttctgctttttttttttttaatttattctatagagcctattctgtctctccccccttcctatgtgaagtcttccctgactcaagtggtctcagttttccctgaactcttgttgacttcatcttccttaactgtcaaccatgccttgtcttccagcttgctttaatatcttctttgtccatagccaaggctgatcagcataggacaatcaggacaatatgaatgatgctcaaatatgtgctaacagtcattttgctgactgttctggagactcccattccttttgaaaacaaagatgggcttttcaaatgaggttatagttcaggggctttgttttgaattattttgtaagacctgaactaataaaagccctatacagagagacattcggtagctattagtattggttatctttaatgtgtacaatgctttgagcgtgatggctcaaaattactattcttagtatttataagttctactgacattagattttgaatctgtcatctcagttcatatagtatatattatcaattgaatcaataaaggtaaggctcattaggagattatttgccatgattaatgattgtggaagaaagaaattcatattttttccacatatttcatcttattttaatagtaatgtccttaaactttactataaaaaaatataatgtc

SEQ ID NO: 6281 - DNA, 815 bp, Homo sapiens
acggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttagttattcagaggctgctctgctgagaagatgaacaaatttcttgtccaaaacaatgtatttcaaacgtgccgctcgggcctttcccgtattgctcactggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgtt

SEQ ID NO: 6282 - DNA, 1744 bp, Homo sapiens
ccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaatcttataaaaaaaataaatgactatcaaaaaagagaaaaaccttacgttatgttctactagttaagttttcaaggacagtgttcactagtctaccatagaccctagaagagttacccaacacatagtagcactcaaatatttgttgaatgaattataaaaatgactacttgtactgttaattttgtgtattctagtgaattaaatctcttcggcatcatttactcccttaggtatttgactttgtgtcaaatgttttggcaaggataaaattataacagactttcttgaacaaccaaaatataatctattaaggattttccttcacttttgataaaataagaaaaaaggaaattaaaaccttgcatcctaatgtaaaatagaattatatggtgtttaatatcagtgtctctttagctattatattaaactactatagttaatacattttatcattattttgtatgttggtttttaaaaatttcataaagctataaaaagatacttggtcagataaagtttcctctgcttttaattttgataaagtattatgtatatgatttctttttacctattatatatatgcatctattgttttctcactggtaaatatgggacggacattttgttagaaggttagaagtgagttaaattttcacattcccaagggtacttttgtctcgggttgttgaatatattttaaagtgtttataataatcacttcaaaatatttaggtaattaactgtaaattatgttttggtattctccagggacagtggccttagagctattgagaatttgatgcaaaagaaggggaaatttgattacatactgttagagaccactggattagcagaccctggtaagaagtgagattattaataaccagaatatagttctgtgatatattgtaaatagatgtattagaggaatatctaaaatgaggattaaagcttttgttagtattaaaccaaaaactttttttggttt

SEQ ID NO: 6283 - DNA, 1241 bp, Homo sapiens
ggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaacatttaacagaagagaaacctgatggccttatcaatgaagctactagacaagttgctttggcagatgccattctcattaataaaacagacctggttccagaagaagatgtaaagaaattaagaacgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggta

SEQ ID NO: 6284 - DNA, 661 bp, Homo sapiens
aaggggcgaggcgcttctcgtccagagcccaggtaatccgggcgggatcagcgagcgtcgcgatgtgatgacgtcaggccccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtatcataactattgtggattcaaaatatggattaaaagtgaaataccactaa

SEQ ID NO: 6285 - DNA, 728 bp, Homo sapiens
gtgttggtcccagcggttcagctgaggtagggacgtgctgtaggccggaatgttaccggctgttggatctgcggatgaggaggaggatcctgcggaggaggattgtcctgaattggttcccattgagacgacgcaaagcgaggaggaggaaaagtctggcctcggcgccaagatcccagtcacaattatcaccgggtatttagttattcagaggctgctctgctgagaagatgaacaaatttcttgtccaaaacaatgtatttcaaacgtgccgctcgggcctttcccgtattgctcactggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacagtggccttagagctattgagaatttgatgcaaaagaaggggaaatttgattacatactgttagagaccactggattagcagaccctggtgcagtggcttctatgttttgggttgatgctgaattagggagtgatatttatcttgatggtatcataactattgtggattcaaaatatggattaaaagcaaagaattggacaacttaaaatgacagctctctattctgaggacttgacac

SEQ ID NO: 6286 - DNA, 1812 bp, Homo sapiens
aagggacgaggcgcttctcgtccagagcccaggtaatccgggcgggatcagcgagcgtcgcgatgtgatgacgtcaggccccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacc

SEQ ID NO: 6287 - DNA, 721 bp, Homo sapiens
aagggacgaggcgcttctcgtccagagcccaggtaatccgggcgggatcagcgagcgtcgcgatgtgatgacgtcaggccccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaagtgaaataccactaa

SEQ ID NO: 6288 - DNA, 1665 bp, Homo sapiens
gtcaggccccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattg

SEQ ID NO: 6289 - DNA, 1820 bp, Homo sapiens
gtcaggccccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttagttattcagaggctgctctgctgagaagatgaacaaatttcttgtccaaaacaatgtatttcaaacgtgccgctcgggcctttcccgtattgctcactggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattg

SEQ ID NO: 6290 - DNA, 661 bp, Homo sapiens
aagggacgaggcgcttctcgtccagagcccaggtaatccgggcgggatcagcgagcgtcgcgatgtgatgacgtcaggccccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtatcataactatagtggattcaaaatatggattaaaagtgaaataccactaa

SEQ ID NO: 6291 - DNA, 2165 bp, Homo sapiens
aaaaagaaaaaattgtcactggttatccttcaggtataaaaattacaattaaaattgtaatgttataaccttccattctttcccctatgaattaaaacttttttttttaacgagactaaaaaatcaagttgataaaatctatgccctgtgggaactggttaggtcaggctacccactccagatttccagcaggctggcctcagctctacctacagccagtagcttattaaggctctaggcgccagtgacaccttcagacaggtggttagtgcgccctaaggactctccgcagcgtcgctcaggttcacagaacacgcccaggggcgtgtccagctgtcgtcggggagagcccacctccccggggggtgtggctaagggacgaggcagttctcgtccagagcccaggtaatccgggcgggatcagctagcgtcgcgatgtgatgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttat

SEQ ID NO: 6292 - DNA, 720 bp, Homo sapiens
agaatgaattaaataatgaggaccctttcatcagggtttctgagtgagttttttaaaatacaaggtagtagtttgtgtaaatactaaatccattggtacctgtgcagaatgtaggaaatggagttgctaattccaaaaaaacagcacatatgctgaggaaagtataatacgtaatatatatggtttaagcaatgtaaaattccatgaatatgttcctttcatcttaaaatttgtgatttaaaaaacattgatattactataaagaattattattatttcccttgatttacagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactggg

SEQ ID NO: 6293 - DNA, 1060 bp, Homo sapiens
gtcctgtccccatcagtgttgaaatgtatgctacagttattatggttgtaatttgttatgccatgttgatcttcttgtgcttttcatatcagaacaatgtatttttaacattctgactttctttttctctcaattggtaactgactatatagaaaatttatatttatggatactatttcttttttaataagttcaagggaaaacattgataaaggaaaatttatcctttcaactttctttaggtgccagcattattttcatattaggaagcaggagaaagttaaggaactctaagcaatactagaatggttatatatatatttaagtttgtattaaacctgttggaatggtaaagaaatttactgacatatttaaccatacaaaatagtgttgctaaaagactagtttttctctttattctgtgcatatgtatatatatgaatgtgtgttttttttaagaaattttaaaaaaacttaatctgccagcttttctctattggaatttgcgaacaacttgtaaaattggaattacagaatattagaatagtcagttatggaaagtcacttcattatccttgtgtcactaaataacgtataaagttaaatcagaagtgtattcatctctgaatttctaatcagttgtttttagtttgcagaaaaaacttcagcatgtgccaggaacacaacctcaccttgatcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactggg

SEQ ID NO: 6294 - DNA, 2411 bp, Homo sapiens
attagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaaggtacagtttactgttgcagacttttggacaaagtccttttcttggctgttataaaaactatatttggttttaaacagaaacactggttttagtacaaatcatctttgtctactttcatttttctttattattttcatgactgaaaaggagctttggaaatcactgcataaggcttgatttatttgcacaactttctttagggttgcagctagaacaaacctgtgtgctttgaaatgttaccttctgctctctgttcccaagtacagagaaataatgttgcaaatctcacttctgctgaacattatgcttcctgatgcatttagcagacactaaacatttgttgtactctaaacaaagttacaaaggactagaagaattcttgttctgtatttagaaacccactcacattacttgatatttgggtatttaagtcatgaaaggtatttcttctaggaagcagtgattctaaagtgtatgcttaaccagtcagttgagtgtctactcttgtgtgttcacaagtgtgcacaaagtttttggtaaattaagaatattatttcaaataaattaatttcatccccataggagccagtttatcagataattcgtttctcatttctgcaaatcaatacacaatgagctcatattcagataaattgagctcatatccagataaatataatagtttttctttatttcaacattgttcattgattgcaacccatttctaaaacaaattatttaatataacaaaactcctttaacttctcaacttttcccactaaaactgtgaaacattatataaaatctttaatcaataggatatgatacatatttcatcattttgtttcaggttttggttgtgataaataacactgaaaaaccatcctaatatatgtattaactttatcattagaaaaggggattgttcaaaaaaaaatcaatacacagaaaccttttttgaaaattaaaaacattaagaaacttcttgtaattcacaaataattggaattaagtaattttctcagcttaagagtttgtattttttaagtgaatatcagtaattaatccattaacattgatgctctatttctgcttttaagtttgaactgaggctgattaatgttcagtcaattctcctttgagcagggattggtgtcaatcaaagacaaatcacaacaagtgattgtccagggtgtccatgagctctatgatctggaggagactccagtgagctggaaggatgacactgagagaacaaatcgattggtcctcattggtaagtctcaaaggattcacagttttgaaacaaagtgaaaaatatatttgaaagggatatcatgtgccacttaaacagattaaccattcaggtcctcttttaaaactaaataagcttgtggtcaatgtttcatctttgtcacattacaacgttcgtaaaagcttgttaggacttttgttcttcttcaattttagaaaagtggttaatccaaggaccaatgtgactttgatgtactgacctggaaagttaaagatggaatcactcaattactattctttttgtaaatttttaaacaccataaagcatttaatgaactggaattgataggtgaactgtgtcattttaataagcataatgtaatcacgtcatattttgttttgtttgcaggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggtt

SEQ ID NO: 6295 - DNA, 1234 bp, Homo sapiens
gtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggt

SEQ ID NO: 6296 - DNA, 1402 bp, Homo sapiens
gcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcagaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggt

SEQ ID NO: 6297 - DNA, 861 bp, Homo sapiens
gggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcagaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatacttctaagtgttcaaccttataaaa

SEQ ID NO: 6298 - DNA, 1665 bp, Homo sapiens
gtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattg

SEQ ID NO: 6299 - DNA, 552 bp, Homo sapiens
gtgcttgtattacaggcatgagccactgtgcacagcctacttatattatttaaaaaacaattaatcaaataagttggttaggattagtttcagtggcataaacagaaacttaaacaatgtgaaagcttatttctgtctccttctgccaggtgaacacacagtgttcatcccctcaggaggacacagcttttgaggtaccatcttggaagcagagaccagccctcactagacacaaacttcctggcacgttgattttggacttcatagcctctagaactttattcagaggctgctctactgagaagatgaacaaatttcttgtccaaaacaatgtatttcaaacgtgcccctcgggcctttcccgtgttgctcactggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgt

SEQ ID NO: 6300 - DNA, 649 bp, Homo sapiens
gtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaagtgaaataccactaa

SEQ ID NO: 6301 - DNA, 1572 bp, Homo sapiens
aggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatcttctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgtta

SEQ ID NO: 6302 - DNA, 1464 bp, Homo sapiens
catgctgggctcgcgagccgcggggttcgcgcggggcctgcgggctgtggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggcttgacatttaattggggagcgttacttggatggtctgctatcaagggttcctgtgatccatctgtttgcctgcctctttatttttctggagttatgtggacactaatatatgatactatttatgcccatcaggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagaaatggggtcttgagattttgcccaggctggtctgaaattcctggcttcaagcaatcttcctgccctggtctcccaaaagtgctgggattaccagtgtgagctaccaaccccagccaaggtatattattttttaaaaataatataggcctaaatccaaattttcccatctgattttcctggaattacttctgattcatgtctggaaaaatttcagtgatatctgaagcttgtggtttgagttgaattactctaaaagcaaactgacagataaagcttttaaaaaaaaatctgggtttctagtgatggttagtagactaattattcataaatttggtttctgctggcataaagaccaaggacagataagacatgaaatgcggaacatgtcaaagttctgccagtagagagcaggaagctgtcatttcaggatattcacccacaccacatcccctacctgtcagaaacttatgttgagaatctacattgttgacttgtaaatgaatgaactaaa

SEQ ID NO: 6303 - DNA, 1641 bp, Homo sapiens
atgaccccaatttcacaagtaaggatgaggaaaggttctgcccacaccgccgcccagcctggcagactaggattgcatcctgcgggtgccactgcgcatgcctgccggggaatgacgtcaatccgagctcgtcccggcctcaccagcgccatgctgggctcgcgagccgcggggttcgcgcggggcctgcgggctgtggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggcttgacatttaattggggagcgttacttggatggtctgctatcaagggttcctgtgatccatctgtttgcctgcctctttatttttctggagttatgtggacactaatatatgatactatttatgcccatcaggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagatttacactctagacatccacagacctgaggattgttggaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatgggaa

SEQ ID NO: 6304 - DNA, 1639 bp, Homo sapiens
atgaccccaatttcacaagtaaggatgaggaaaggttctgcccacaccgccgcccagcctggcagactaggattgcatcctgcgggtgccactgcgcatgcctgccggggaatgacgtcaatccgagctcgtcccggcctcaccagcgccatgctgggctcgcgagccgcggggttcgcgcggggcctgcgggctgtggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggcttgacatttaattggggagcgttacttggatggtctgctatcaagggttcctgtgatccatctgtttgcctgcctctttatttttctggagttatgtggacactaatatatgatactatttatgcccatcaggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagatttacactctagacatccacagacctgaggattgttggaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatggg

SEQ ID NO: 6305 - DNA, 1548 bp, Homo sapiens
gggaaaaccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagggctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacaccctgctggggatgcccaccaacatcctgggggagatcgtggtgaaatggtttgaggctgtccagactggcctgcccatgtgcatcctgggtgcattctttggaccgatccgacttggcgctcagagcctgcaagtgctggtctcggagttgatcccatgggccgttcagaacgggcgcagagccccatgtgtcctcaacctgtactatgagcggcgctgggagcagtccctgagggctctgcgggaggagctgggcattacagcaccacccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggtcaa

SEQ ID NO: 6306 - DNA, 928 bp, Homo sapiens
cgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagggctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacgtgagttttcagctcctgtgtatctggcagtcaccagacaggacagaggaatagcacaggcatgacaccctgaggaaagaggagccctgagctgccaccattggcaggagtgctcttcaggctcatgccaaggctttgtcattttctatgggataggcaaatgggtgggaacatgcctgcaattgataatactggccagtgttcattaacctcgcactgcatgcctgatgccagcctcatccgtgatcttgctgaatccccccacaactctgtcaagtatgttctattattatcctcttttagcagataaggaaacagaggctcagagcagtgaagcaaacttgctaattccacataactggtattaatggagatagtaatcaatcccagatcatgctcttcactgctgtactgtatccctttattccagggacattgctttccctacggtatggcaggtgtggcactctccagcccctccagccccaggcagggaggacaaggagagggggaaagggg

SEQ ID NO: 6307 - DNA, 2657 bp, Homo sapiens
gtccgagccaagggcactattggccagttccgttcaacgaagtggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttacgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaagtaagtcaaagatcatcgtttctgttttgaattgtgggtgataatgggtgggagagtgctacagtctgtatgtctgtgtctccctagaattcatacgatgaaatcttcactctcaagttgatagaaggtggggcccttgggaagtgtgaggtcatgagagtggagccctcatgaatgggatcagtgccttatgaaaggccctagagagatacctcatcctctccacagtgtgagacttcaaggggaagtatgagacttctctgaggaagcagacccttcacaagcaaaatcagccagcactttgatcacggacttcccagcctctaggactgtgagcaataaatgtttgatgtttataagccacccagactgtggtattttgttatagcagcctgaacagactaagacgggggtgttgcttccatcaaaggatgtactaagttgtggattatttgtgaaattgaattacaaccttttccttaaggtcttttaccacctcccccccaaaaaaatcccccaaaactgattcagattttcatactttaatgaaatattttataatttgcaaatttttaagtaatttatgaaaaacctagatcagtggatctcctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattcaaaagggtattatttggtttttctgtaaattgaaccttgaaataaaagcacaacaaggttttcttaa

SEQ ID NO: 6308 - DNA, 2608 bp, Homo sapiens
agcggcgagagtgacaggaggacaggggttgtttcggcagtgacgcctggggagtgacgcaattgcacccctgtgcagtgatgtcacggcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttacgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaagtaagtcaaagatcatcgtttctgttttgaattgtgggtgataatgggtgggagagtgctacagtctgtatgtctgtgtctccctagaattcatacgatgaaatcttcactctcaagttgatagaaggtggggcccttgggaagtgtgaggtcatgagagtggagccctcatgaatgggatcagtgccttatgaaaggccctagagagatacctcatcctctccacagtgtgagacttcaaggggaagtatgagacttctctgaggaagcagacccttcacaagcaaaatcagccagcactttgatcacggacttcccagcctctaggactgtgagcaataaatgtttgatgtttataagccacccagactgtggtattttgttatagcagcctgaacagactaagacgggggtgttgcttccatcaaaggatgtactaagttgtggattatttgtgaaattgaattacaaccttttccttaaggtcttttaccacctcccccccaaaaaaatcccccaaaactgattcagattttcatactttaatgaaatattttataatttgcaaatttttaagtaatttatgaaaaacctagatcagtggatctcctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattcaaaagggtattatttggtttttctgtaaattgaaccttgaaataaaagcacaacaaggttttctt

SEQ ID NO: 6309 - DNA, 1615 bp, Homo sapiens
cgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgttcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagt

SEQ ID NO: 6310 - DNA, 2698 bp, Homo sapiens
cgggaccgggtgggcgcatgcgcgctgggctggctgggcggggtctctcgcgccgggtgagggcgctgctcccaggaacctgcgcgcggccccggcggcgtttcccgggggccggttggcgggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccgtctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccagtttgcaggtgtggccttgtttctccttgcccagcagtgctgccttcagcggccgtgacggggccagctggacacacggtgagattttctcgtatgtaaataaaaggcattttggtaaacgtg

SEQ ID NO: 6311 - DNA, 3129 bp, Homo sapiens
ggcccgccgagccccgccacctccctcgggctgcagctcccggcgtgccccgcactctccgctgcccacccgctcgcccgcccctccttctcctcccagtgccacagagccgaagcccgagctgccgccgcagccacagccgagggcactatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgataatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgtaaagctgttgagatgtgtttacttatacttcagaacattaaaagtttaaaaactggt

SEQ ID NO: 6312 - DNA, 3131 bp, Homo sapiens
aaacatttcagggatgggacaacttgtatttgtccctttcgcttccacgtccaaacccctttaagaaggatgaatgggcaggatgagttagactccttcgctgtatcgtctactgattcttaaaatgtgacaaatctgattggacgacttacatggcttctggagttacagtgaatgatgaagtcatcaaagtttttaatgatatgaaagtaaggaaatcttctacacaagaggagatcaaaaagagaaagaaagcagttctcttctgtttaagcgatgacaaaagacaaataattgtagaggaagcaaagcagatcttggtgggtgacattggtgatactgtagaggacccctacacatcttttgtgaagttgctacctctgaatgattgccgatatgctttgtacgatgccacatacgaaacaaaagagtctaagaaagaagacctagtatttatattctgggctcctgaaagtgcacctttaaaaagcaagatgatttatgctagctctaaagatgccattaaaaagaaatttacaggtattaaacatgagtggcaagtaaatggcttggatgatattaaggaccgttcgacacttggagagaaattgggaggcaatgtagtagtttcacttgaaggaaaaccattataaaatgacagtcaagtgccatctggatcttaaggagcttccatttctccagctcagtccattggaatagtattaggttttggttttttgttgtatttccccctttccactgggcccttccaacacaatgaatgaaggaaatatcatttatttaagcagcctatcagtgattgccattagactgttgaatactgttacttttatatagaacccaaggaatgccttcctgtcatattttagccaaaacaactggttatatgcctcccttgcagcaagcactacaatgtatgtgatcgtcaatgtgaatagcttagaatactgcaaaggataagctaattgaatgccttgaaagtattatccactggtcagatggtcaacttttttcagtattatttatagttggcacttgattgcagttctgtgaggcttgagcattcatacacctcacctgccttggcaagcctattttagtgatatggcagcacggatataacactatgcattaaaagcactttttgtaataagtttaatatcctaaaaggaatgccaattaagttttgttaactgtgtcatcaacttatcctagtacctcagtgttcattcctgttacctgcatatcttcttaaaagaaatagctgttattaatgcctttttgttttccattgagtgtacactactgaataagtgtaggagttttatgtttaccatgtgagtcctgcaacactaaagatattttgaatatcagtcatgatggcaatttctgtataaaagagccttaaatggaacattgttttgagatcaaactccccaccctcacaaaaatggccacgttgcaataaaaattgtggcatattacagaacgttgccttgttttccttggaaattttgcaaaatgttatgtgaaacaacttctagggtaaaaacagctattactaatctctgcactggtcatttgagaattttttttgtacagcattcatgtgtgatattttccagatttgttggatctatttggtttaaaaagtattctatcttaaggccaactaatataaaataccattgttaaagaatggtacttttataaacattagtgtatttatttcctatgtgttaatatgaagatcagaaattattttttgcactttggcataaatacttttcaatatctgatttgttctctggataaattagcatagttatttttttattcacatttacatttctaagtagttgtatagtagaagcaggaagctcttattgcttatttggtcgtaatgaaaataatttgtaaaatgtcctttaaaagtttaatgatacttctgatgtttcggaacagtcatttcacctactatttctgaatatattttgcaaattgaattggaataggaattgataatagcagtcttaaacattagtagtgggatttggctatggtccagactgtgctccttatagagaatttgatctgctcagtgtgagcggtttgctgttagccagggctatttatggcaaacacatgcttttgtatcttgtcatagttatccacaaatggcaaaactggacttgattctactggtatgcaaaacaggcatgctagtaagcagtcagtcgtggctcagaacttaaccccatagctcagaggaatgcttttagcagaaaacaggaaagaaaatatcccttaaaaattttttttgaatgtgtggaagtaattttagtataattagattttttccatatttttgaaagatttttcagatgtgaacattaaaaatagggattaaatgtctaggcttccatttaaaattatatgaatggtttgggatctttttgcactgagcaattttatttcaggcttccagctgtccctgtgagttatcctggacatttcgatggtttttggtaaggccaaactctgataagcaaaacagagaatactgacgtatacttaaccatatgtgtaactgatacttggcaccatggaatttttcattgagttatttcctcattcttttaaaaaataagggactataaatcagttatgtagtatcttttgtttttgtagctgattccttaactttcttgtatgcctctagtaatttcagagattaaatattgctttaaactgtgatactttgatttgctagattgacaaaactgatactaatataattaagttcatctttgaaatacatctttgtgcgtagagccaaaaaaagagataaaattaataatagttcacttgttatttgagattaatttggcatttgaaatgatcattttattttacaatcatttataatgaatcaatgttccagttagctttaaaaggtatacggtgctaattagtaaaatattgaaggcaatattttactgctagcttgcaaagttatgagagtttaaaaaataaaatatatgaaaatatgtaaagctgttgagatgtgtttacttatacttcagaacattaaaagtttaaaaactggt

SEQ ID NO: 6313 - DNA, 2992 bp, Homo sapiens
acagtcagcaccgccccagccaggcgcctgcgcgcccacgcactacctgccgggagttgtagtttcggctcggcagacccggcgagcccagtggccgcgctccggtgcggcggcgcccgaggcccgaggcggaagtgggacggccaagcagggaagcgagggctcgggatcgacggccgcggggcgccgacgaggagtgcaggactcaggaagggcgagtgcgcggcgacagagcccggggaaggaggcagggcaaggccgggcttgggggcaggtggtccgggcatccagccttgaagatgcacaagaggaaaggacccccgggacccccgggcagaggcgccgcggccgcccgccagctgggcctgctggttgacctctccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaagggggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacagttgctgggcccaaagggaaggcccctcctgtgcctgcccctgcaagggagtcagggaacagatcagcccggcccctgcatagcctcagtgtgctggcgtttgaccaagagcgtctggagcggaagatcctggccctcaggcaggcgcggcggccggtgcccccagaagtggcccagcagtaccaggacatcatgcaacgcagccagtggcagagggcacagctggagcaggggggtgtgggcatccgacgggaatacgcagcccagctggagcggcagctgcagttctacacggaggctgcccggcgcctgggcaacgatggcagcagggatgctgcaaaggaggcgctctataggcggaatctggtagagagtgagctgcagcggctccgcaggtgaggagcccatggggcgggcagcccccagaaagcgggcagcaggccccgataccgggaagagccgacacagccacgaaccagacaagcagacaatcagcggacaatcggttctggactcacccctcatccgggcccccagccccgccagagcctccgtggctgcgggtgttgggaaccatgcctgccagccagtatgtgcccctcacccaggcctggctgggccctggagagtcctgtttgcacagcccaggggtgtccggcctctggcccgccccggagcagggagggtggctggggccaagccccgagggcccctgcaagcactttacttcctgttcctccccagccttaaccccaaagccctcctgcaccccaaagaagccactgaggctggccgagccacactgtctccccaggggcgtcgacctggcccagctgggtccccagggccagcacatggaataaaatagccagggccacactcag

SEQ ID NO: 6314 - DNA, 3640 bp, Homo sapiens
acagtcagcaccgccccagccaggcgcctgcgcgcccacgcactacctgccgggagttgtagtttcggctcggcagacccggcgagcccagtggccgcgctccggtgcggcggcgcccgaggcccgaggcggaagtgggacggccaagcagggaagcgagggctcgggatcgacggccgcggggcgccgacgaggagtgcaggactcaggaagggcgagtgcgcggcgacagagcccggggaaggaggcagggcaaggccgggcttgggggcaggtggtccgggcatccagccttgaagatgcacaagaggaaaggacccccgggacccccgggcagaggcgccgcggccgcccgccagctgggcctgctggttgacctctccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccaggcttccccccaatccagggcctggaggccaccaagcccacccagcagagtctggtgggtgtcctggagactgccatgaagctggccaaccaggatgaaggcccagaggatgaagaggatgaggtgcctaagaagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaagggggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacacaggttgctgggcccaaagggaaggcccctcctgtgcctgcccctgcaagggagtcagggaacagatcagcccggcccctgcatagcctcagtgtgctggcgtttgaccaagagcgtctggagcggaagatcctggccctcaggcaggcgcggcggccggtgcccccagaagtggcccagcagtaccaggacatcatgcaacgcagccagtggcagagggcacagctggagcaggggggtgtgggcatccgacgggaatacgcagcccagctggagcggcagctgcagttctacacggaggctgcccggcgcctgggcaacgatggcagcagggatgctgcaaaggaggcgctctataggcggaatctggtagagagtgagctgcagcggctccgcaggtgaggagcccatggggcgggcagcccccagaaagcgggcagcaggccccgataccgggaagagccgacacagccacgaaccagacaagcagacaatcagcggacaatcggttctggactcacccctcatccgggcccccagccccgccagagcctccgtggctgcgggtgttgggaaccatgcctgccagccagtatgtgcccctcacccaggcctggctgggccctggagagtcctgtttgcacagcccaggggtgtccggcctctggcccgccccggagcagggagggtggctggggccaagccccgagggcccctgcaagcactttacttcctgttcctccccagccttaaccccaaagccctcctgcaccccaaagaagccactgaggctggccgagccacactgtctccccaggggcgtcgacctggcccagctgggtccccagggccagcacatggaataaaatagccagggccacactcag

SEQ ID NO: 6315 - DNA, 3266 bp, Homo sapiens
tggcactccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccaggcttccccccaatccagggcctggaggccaccaagcccacccagcagagtctggtgggtgtcctggagactgccatgaagctggccaaccaggatgaaggcccagaggatgaagaggatgaggtgcctaagaagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaagggggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacacaggttgctgggcccaaagggaaggcccctcctgtgcctgcccctgcaagggagtcagggaacagatcagcccggcccctgcatagcctcagtgtgctggcgtttgaccaagagcgtctggagcggaagatcctggccctcaggcaggcgcggcggccggtgcccccagaagtggcccagcagtaccaggacatcatgcaacgcagccagtggcagagggcacagctggagcaggggggtgtgggcatccgacgggaatacgcagcccagctggagcggcagctgcagttctacacggaggctgcccggcgcctgggcaacgatggcagcagggatgctgcaaaggaggcgctctataggcggaatctggtagagagtgagctgcagcggctccgcaggtgaggagcccatggggcgggcagcccccagaaagcgggcagcaggccccgataccgggaagagccgacacagccacgaaccagacaagcagacaatcagcggacaatcggttctggactcacccctcatccgggcccccagccccgccagagcctccgtggctgcgggtgttgggaaccatgcctgccagccagtatgtgcccctcacccaggcctggctgggccctggagagtcctgtttgcacagcccaggggtgtccggcctctggcccgccccggagcagggagggtggctggggccaagccccgagggcccctgcaagcactttacttcctgttcctccccagccttaaccccaaagccctcctgcaccccaaagaagccactgaggctggccgagccacactgtctccccaggggcgtcgacctggcccagctgggtccccagggccagcacatggaataaaatagccagggccacactcag

SEQ ID NO: 6316 - DNA, 2153 bp, Homo sapiens
acagtcagcaccgccccagccaggcgcctgcgcgcccacgcactacctgccgggagttgtagtttcggctcggcagacccggcgagcccagtggccgcgctccggtgcggcggcgcccgaggcccgaggcggaagtgggacggccaagcagggaagcgagggctcgggatcgacggccgcggggcgccgacgaggagtgcaggactcaggaagggcgagtgcgcggcgacagagcccggggaaggaggcagggcaaggccgggcttgggggcaggtggtccgggcatccagccttgaagatgcacaagaggaaaggacccccgggacccccgggcagaggcgccgcggccgcccgccagctgggcctgctggttgacctctccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccaggcttccccccaatccagggcctggaggccaccaagcccacccagcagagtctggtgggtgtcctggagactgccatgaagctggccaaccaggatgaaggcccagaggatgaagaggatgaggtgcctaagaagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaaggctaacatggtgaaaccctgtttctactaa

SEQ ID NO: 6317 - DNA, 4790 bp, Homo sapiens
aagccaactcctttctcccgagcctgctggcagatcctcccccacctctccgcaggagttcccctcctaggctgggagcatcccgtgcagggtaaatcttttcaagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaaagggccaagaagaagaaaaggaaacaagcagcagaagaacatcccggtgatgagattgcagagccgtatcccgaggaggaccttgtgaagcccagccctccagagcccactgatcgggcagtgatagagcaggaggtgagggagagagcagcccagagcaggaggaggccttgggagcccacgctggtcccggagctaagcctggcaggaagcgtaacacccaatgaccagtgccccagagcggaggtctcgagaagggaggatgtaaagaagcgctcagtgtacttaaaagtgctgttcaacaacaaggaggtgtccaggacagtcagtcggccactaggagcagacttccgagttcactttgggcagattttcaatttgcaaatagtcaactggccggagagtttaacacttcaggtctatgaaactgtcggacacagtagtcccaccttgctagcagaagtgtttctgcctattcctgagactactgttgtcactggaagggctcctactgaagaagtggagtttagcagtaatcagcatgtgacactggaccacgagggagttggaagtggagtgcccttctcatttgaagctgatggcagtaaccagctgactctgatgacctcagggaaagtgtctcatagtgtggcatgggccattggagaaaacgggatacctttaattcctccattgtcacagcagaacatcggatttcggagtgctttgaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctccagcaggttagagaatcagtgataaatcgtttcttaattgcaaaacaatattttcttcttgctgatatgatagtagaagaagaagttcccaatatcagcattttgggcctaagccttttcaagctggcagaacaaaagcgaccactgcggccaaggagaaaaggtcggaagaaggtgacagcccaaaacctgtctgatggagacataaagctgctggtgaacattgtgcgagcttacgacattccagtgaggaagccggcagtgagcaaattccagcagccgtcgaggtcttcaaggatgttcagtgaaaagcatgctgcttccccaagcacgtacagcccaacccacaatgctgactaccccctcggccaggttttagtacgtccctttgtagaagtctcttttcaacgaacagtttgccatacgactacggctgaaggaccaaaccctagctggaatgaagaactagaacttccatttagggctcctaatggagattatagcacagccagtctgcagtcagtgaaagatgttgtgttcattaacatttttgatgaagtactgcatgatgtcttagaggatgaccgtgaaagaggaagtggaatccatactcgtattgagagacactggctgggatgtgtgaaaatgccatttagcacaatatatttccaagcaaggtttgagtctcaggaagatgagaaattacttcaagcaactgagaagtttcaagctgaatgtgccttaaagtttccaaatcgtcagtgccttacaacagtaattgatataagcggaaaaactgtttttatcacacgttatctcaaacctttaaaccctcctcaggagctccttaatgtctaccccaataatctacaggcaactgcagaactggtggctcgatatgtgtccttgattcccttcttgcctgacactgtctcatttggtggtatctgtgacctctggagcacatctgatcaatttcttgatctcctggcaggggatgaagaagaacatgcagtactattgtgtaattactttctgtctctgggtaagaaggcctggctgttgatgggcaatgctattcctgagggtccaactgcctatgtgctaacttgggagcaaggtcgttatttaatatggaatccctgcagtggacatttttatggacaatttgatacattctgtcccttgaaaaatgtgggctgtttaataggtcctgacaatatttggtttaatattcaacgatatgaatctccactaaggataaattttgatgtcaccaggcccaagctatggaaatctttcttttcaagaagccttccatatcctggcctttccagtgttcagcctgaagagctaatttaccagcgctcagacaaagcagctgcagctgagctacaagacaggattgaaaaaatactaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaatttttttcactgtactttctgtatcatgtaaaaactacacttaggatatgagaaaattttaaattatatgcatcacatcagaagaacatattattggcaaataataaaattatcaactgtt

SEQ ID NO: 6318 - DNA, 5234 bp, Homo sapiens
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaaggtaaatcagtccctatgttctttgtcagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaaagggccaagaagaagaaaaggaaacaagcagcagaagaacatcccggtgatgagattgcagagccgtatcccgaggaggaccttgtgaagcccagccctccagagcccactgatcgggcagtgatagagcaggaggtgagggagagagcagcccagagcaggaggaggccttgggagcccacgctggtcccggagctaagcctggcaggaagcgtaacacccaatgaccagtgccccagagcggaggtctcgagaagggaggatgtaaagaagcgctcagtgtacttaaaagtgctgttcaacaacaaggaggtgtccaggacagtcagtcggccactaggagcagacttccgagttcactttgggcagattttcaatttgcaaatagtcaactggccggagagtttaacacttcaggtctatgaaactgtcggacacagtagtcccaccttgctagcagaagtgtttctgcctattcctgagactactgttgtcactggaagggctcctactgaagaagtggagtttagcagtaatcagcatgtgacactggaccacgagggagttggaagtggagtgcccttctcatttgaagctgatggcagtaaccagctgactctgatgacctcagggaaagtgtctcatagtgtggcatgggccattggagaaaacgggatacctttaattcctccattgtcacagcagaacatcggatttcggagtgctttgaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctccagcaggttagagaatcagtgataaatcgtttcttaattgcaaaacaatattttcttcttgctgatatgatagtagaagaagaagttcccaatatcagcattttgggcctaagccttttcaagctggcagaacaaaagcgaccactgcggccaaggagaaaaggtcggaagaaggtgacagcccaaaacctgtctgatggagacataaagctgctggtgaacattgtgcgagcttacgacattccagtgaggaagccggcagtgagcaaattccagcagccgtcgaggtcttcaaggatgttcagtgaaaagcatgctgcttccccaagcacgtacagcccaacccacaatgctgactaccccctcggccaggttttagtacgtccctttgtagaagtctcttttcaacgaacagtttgccatacgactacggctgaaggaccaaaccctagctggaatgaagaactagaacttccatttagggctcctaatggagattatagcacagccagtctgcagtcagtgaaagatgttgtgttcattaacatttttgatgaagtactgcatgatgtcttagaggatgaccgtgaaagaggaagtggaatccatactcgtattgagagacactggctgggatgtgtgaaaatgccatttagcacaatatatttccaagcaaggattgatggaacatttaaaatagatattcccccagttcttctgggctacagtaaggagcgaaatatgattcttgagcggggttttgattctgtccgaagcttaagtgaaggctcctacattaccctctttattaccattgagccccagctggttcctggagagtccattcgagaaaagtttgagtctcaggaagatgagaaattacttcaagcaactgagaagtttcaagctgaatgtgccttaaagtttccaaatcgtcagtgccttacaacagtaattgatataagcggaaaaactgtttttatcacacgttatctcaaacctttaaaccctcctcaggagctccttaatgtctaccccaataatctacaggcaactgcagaactggtggctcgatatgtgtccttgattcccttcttgcctgacactgtctcatttggtggtatctgtgacctctggagcacatctgatcaatttcttgatctcctggcaggggatgaagaagaacatgcagtactattgtgtaattactttctgtctctgggtaagaaggcctggctgttgatgggcaatgctattcctgagggtccaactgcctatgtgctaacttgggagcaaggtcgttatttaatatggaatccctgcagtggacatttttatggacaatttgatacattctgtcccttgaaaaatgtgggctgtttaataggtcctgacaatatttggtttaatattcaacgatatgaatctccactaaggataaattttgatgtcaccaggcccaagctatggaaatctttcttttcaagaagccttccatatcctggcctttccagtgttcagcctgaagagctaatttaccagcgctcagacaaagcagctgcagctgagctacaagacaggattgaaaaaatactaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaatttttttcactgtactttctgtatcatgtaaaaactacacttaggatatgagaaaattttaaattatatgcatcacatcagaagaacatattattggcaaataataaaattatcaactgttttcaaactgtg

SEQ ID NO: 6319 - DNA, 5249 bp, Homo sapiens
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaaggtaaatcagtccctaaccggactttaggctgcaacattgtcagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaaagggccaagaagaagaaaaggaaacaagcagcagaagaacatcccggtgatgagattgcagagccgtatcccgaggaggaccttgtgaagcccagccctccagagcccactgatcgggcagtgatagagcaggaggtgagggagagagcagcccagagcaggaggaggccttgggagcccacgctggtcccggagctaagcctggcaggaagcgtaacacccaatgaccagtgccccagagcggaggtctcgagaagggaggatgtaaagaagcgctcagtgtacttaaaagtgctgttcaacaacaaggaggtgtccaggacagtcagtcggccactaggagcagacttccgagttcactttgggcagattttcaatttgcaaatagtcaactggccggagagtttaacacttcaggtctatgaaactgtcggacacagtagtcccaccttgctagcagaagtgtttctgcctattcctgagactactgttgtcactggaagggctcctactgaagaagtggagtttagcagtaatcagcatgtgacactggaccacgagggagttggaagtggagtgcccttctcatttgaagctgatggcagtaaccagctgactctgatgacctcagggaaagtgtctcatagtgtggcatgggccattggagaaaacgggatacctttaattcctccattgtcacagcagaacatcggatttcggagtgctttgaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctccagcaggttagagaatcagtgataaatcgtttcttaattgcaaaacaatattttcttcttgctgatatgatagtagaagaagaagttcccaatatcagcattttgggcctaagccttttcaagctggcagaacaaaagcgaccactgcggccaaggagaaaaggtcggaagaaggtgacagcccaaaacctgtctgatggagacataaagctgctggtgaacattgtgcgagcttacgacattccagtgaggaagccggcagtgagcaaattccagcagccgtcgaggtcttcaaggatgttcagtgaaaagcatgctgcttccccaagcacgtacagcccaacccacaatgctgactaccccctcggccaggttttagtacgtccctttgtagaagtctcttttcaacgaacagtttgccatacgactacggctgaaggaccaaaccctagctggaatgaagaactagaacttccatttagggctcctaatggagattatagcacagccagtctgcagtcagtgaaagatgttgtgttcattaacatttttgatgaagtactgcatgatgtcttagaggatgaccgtgaaagaggaagtggaatccatactcgtattgagagacactggctgggatgtgtgaaaatgccatttagcacaatatatttccaagcaaggattgatggaacatttaaaatagatattcccccagttcttctgggctacagtaaggagcgaaatatgattcttgagcggggttttgattctgtccgaagcttaagtgaaggctcctacattaccctctttattaccattgagccccagctggttcctggagagtccattcgagaaaagtttgagtctcaggaagatgagaaattacttcaagcaactgagaagtttcaagctgaatgtgccttaaagtttccaaatcgtcagtgccttacaacagtaattgatataagcggaaaaactgtttttatcacacgttatctcaaacctttaaaccctcctcaggagctccttaatgtctaccccaataatctacaggcaactgcagaactggtggctcgatatgtgtccttgattcccttcttgcctgacactgtctcatttggtggtatctgtgacctctggagcacatctgatcaatttcttgatctcctggcaggggatgaagaagaacatgcagtactattgtgtaattactttctgtctctgggtaagaaggcctggctgttgatgggcaatgctattcctgagggtccaactgcctatgtgctaacttgggagcaaggtcgttatttaatatggaatccctgcagtggacatttttatggacaatttgatacattctgtcccttgaaaaatgtgggctgtttaataggtcctgacaatatttggtttaatattcaacgatatgaatctccactaaggataaattttgatgtcaccaggcccaagctatggaaatctttcttttcaagaagccttccatatcctggcctttccagtgttcagcctgaagagctaatttaccagcgctcagacaaagcagctgcagctgagctacaagacaggattgaaaaaatactaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaatttttttcactgtactttctgtatcatgtaaaaactacacttaggatatgagaaaattttaaattatatgcatcacatcagaagaacatattattggcaaataataaaattatcaactgttttcaaactgtg

SEQ ID NO: 6320 - DNA, 5057 bp, Homo sapiens
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaaggtaaatcagtccctatgttctttgtcagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaaagggccaagaagaagaaaaggaaacaagcagcagaagaacatcccggtgatgagattgcagagccgtatcccgaggaggaccttgtgaagcccagccctccagagcccactgatcgggcagtgatagagcaggaggtgagggagagagcagcccagagcaggaggaggccttgggagcccacgctggtcccggagctaagcctggcaggaagcgtaacacccaatgaccagtgccccagagcggaggtctcgagaagggaggatgtaaagaagcgctcagtgtacttaaaagtgctgttcaacaacaaggaggtgtccaggacagtcagtcggccactaggagcagacttccgagttcactttgggcagattttcaatttgcaaatagtcaactggccggagagtttaacacttcaggtctatgaaactgtcggacacagtagtcccaccttgctagcagaagtgtttctgcctattcctgagactactgttgtcactggaagggctcctactgaagaagtggagtttagcagtaatcagcatgtgacactggaccacgagggagttggaagtggagtgcccttctcatttgaagctgatggcagtaaccagctgactctgatgacctcagggaaagtgtctcatagtgtggcatgggccattggagaaaacgggatacctttaattcctccattgtcacagcagaacatcggatttcggagtgctttgaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctccagcaggttagagaatcagtgataaatcgtttcttaattgcaaaacaatattttcttcttgctgatatgatagtagaagaagaagttcccaatatcagcattttgggcctaagccttttcaagctggcagaacaaaagcgaccactgcggccaaggagaaaaggtcggaagaaggtgacagcccaaaacctgtctgatggagacataaagctgctggtgaacattgtgcgagcttacgacattccagtgaggaagccggcagtgagcaaattccagcagccgtcgaggtcttcaaggatgttcagtgaaaagcatgctgcttccccaagcacgtacagcccaacccacaatgctgactaccccctcggccaggttttagtacgtccctttgtagaagtctcttttcaacgaacagtttgccatacgactacggctgaaggaccaaaccctagctggaatgaagaactagaacttccatttagggctcctaatggagattatagcacagccagtctgcagtcagtgaaagatgttgtgttcattaacatttttgatgaagtactgcatgatgtcttagaggatgaccgtgaaagaggaagtggaatccatactcgtattgagagacactggctgggatgtgtgaaaatgccatttagcacaatatatttccaagcaaggtttgagtctcaggaagatgagaaattacttcaagcaactgagaagtttcaagctgaatgtgccttaaagtttccaaatcgtcagtgccttacaacagtaattgatataagcggaaaaactgtttttatcacacgttatctcaaacctttaaaccctcctcaggagctccttaatgtctaccccaataatctacaggcaactgcagaactggtggctcgatatgtgtccttgattcccttcttgcctgacactgtctcatttggtggtatctgtgacctctggagcacatctgatcaatttcttgatctcctggcaggggatgaagaagaacatgcagtactattgtgtaattactttctgtctctgggtaagaaggcctggctgttgatgggcaatgctattcctgagggtccaactgcctatgtgctaacttgggagcaaggtcgttatttaatatggaatccctgcagtggacatttttatggacaatttgatacattctgtcccttgaaaaatgtgggctgtttaataggtcctgacaatatttggtttaatattcaacgatatgaatctccactaaggataaattttgatgtcaccaggcccaagctatggaaatctttcttttcaagaagccttccatatcctggcctttccagtgttcagcctgaagagctaatttaccagcgctcagacaaagcagctgcagctgagctacaagacaggattgaaaaaatactaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaatttttttcactgtactttctgtatcatgtaaaaactacacttaggatatgagaaaattttaaattatatgcatcacatcagaagaacatattattggcaaataataaaattatcaactgttttcaaactgtg

SEQ ID NO: 6321 - DNA, 1673 bp, Homo sapiens
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaaggtaaatcagtccctaaccggactttaggctgcaacattgtcagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagaagccaactcctttctcccgagcctgctggcagatcctcccccacctctccgcaggagttcccctcctaggctgggagcatcccgtgcagggtaaatcttttcaagccaccaactgctgtccccaaggaaatggtgtccgaaaaatcccaccttggcaacccccaggagcctgtgcaggaggagcccaagacccgcctcctgagtatgacagtccggagaggcccacggagagagctggttgttaaaaagagcctgggcaggccaggcacggtgactcacgtctgtaatcccagcactttggaaggccgaggcgggtaaatcacctgaggttgggagttcaagaccagcctgaccaacatggagaaaccccatctctactaaaaatacaaaaaaattagccaggcgtggtggcgcatgcctgtaatcccagctacttgggaggctgaggcatgagaattgcttgaacctgggaggtggaggttgcagtgagccgagatcggagcactgcactccagcctaggcaacagagcaagactccatctcagaaaacaaacaaacaaaaaagagcctggaacctcctcccctctctcttgctccctctctcaccatgcgacacacctgtttccccttccccttctgacataagtgaaagcttcctaaggcctcaccagaggcagatgctggcaccatgcttattgcacagtctgcagaacagtgagccaaaataaacctcttttctttataaattacccagtctcagatattcctttatagcaatgcaaaatggactaacaatacataagttagggagtgttaattagaatggaaattaaatatgcagaaactcaaaggaagatgaaattgttagggaagacatatgtgttaacctagtgaggcttgaatcagatgtttggaagaaatgagggaggtttctgaggctcctggtgaccttgccattgaggacacatatacttctccccctacacacgccttttcttcttccccagtacaatgaacattaggaattacctgctcattgtagggaaaatgaccacccttcaggcattgcttttcatgaaaagtggattagacaagaggagaagtggttacactttttaattgttacataattgttagactgttttccctatggcaaagttgggaaataagtaactgttggaaactagaggcctttggaagcaagtagactcttagattggaaaaatgtggttctaatctaaaagcaatgatacaatgagagctgttatgaattaataaaaacagaaccaaaattt

SEQ ID NO: 6322 - DNA, 5175 bp, Homo sapiens
gcccaggggcatctccaacactcagcctttccctccggacccttttaaaagattcaacagcaccgtctctctccacttccatcctagaatgcagaatctgcaaagtgccttttgtaaagtttcttaagctatattctaatggatatgggctgacattaacaaggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaaagggccaagaagaagaaaaggaaacaagcagcagaagaacatcccggtgatgagattgcagagccgtatcccgaggaggaccttgtgaagcccagccctccagagcccactgatcgggcagtgatagagcaggaggtgagggagagagcagcccagagcaggaggaggccttgggagcccacgctggtcccggagctaagcctggcaggaagcgtaacacccaatgaccagtgccccagagcggaggtctcgagaagggaggatgtaaagaagcgctcagtgtacttaaaagtgctgttcaacaacaaggaggtgtccaggacagtcagtcggccactaggagcagacttccgagttcactttgggcagattttcaatttgcaaatagtcaactggccggagagtttaacacttcaggtctatgaaactgtcggacacagtagtcccaccttgctagcagaagtgtttctgcctattcctgagactactgttgtcactggaagggctcctactgaagaagtggagtttagcagtaatcagcatgtgacactggaccacgagggagttggaagtggagtgcccttctcatttgaagctgatggcagtaaccagctgactctgatgacctcagggaaagtgtctcatagtgtggcatgggccattggagaaaacgggatacctttaattcctccattgtcacagcagaacatcggatttcggagtgctttgaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctccagcaggttagagaatcagtgataaatcgtttcttaattgcaaaacaatattttcttcttgctgatatgatagtagaagaagaagttcccaatatcagcattttgggcctaagccttttcaagctggcagaacaaaagcgaccactgcggccaaggagaaaaggtcggaagaaggtgacagcccaaaacctgtctgatggagacataaagctgctggtgaacattgtgcgagcttacgacattccagtgaggaagccggcagtgagcaaattccagcagccgtcgaggtcttcaaggatgttcagtgaaaagcatgctgcttccccaagcacgtacagcccaacccacaatgctgactaccccctcggccaggttttagtacgtccctttgtagaagtctcttttcaacgaacagtttgccatacgactacggctgaaggaccaaaccctagctggaatgaagaactagaacttccatttagggctcctaatggagattatagcacagccagtctgcagtcagtgaaagatgttgtgttcattaacatttttgatgaagtactgcatgatgtcttagaggatgaccgtgaaagaggaagtggaatccatactcgtattgagagacactggctgggatgtgtgaaaatgccatttagcacaatatatttccaagcaaggattgatggaacatttaaaatagatattcccccagttcttctgggctacagtaaggagcgaaatatgattcttgagcggggttttgattctgtccgaagcttaagtgaaggctcctacattaccctctttattaccattgagccccagctggttcctggagagtccattcgagaaaagtttgagtctcaggaagatgagaaattacttcaagcaactgagaagtttcaagctgaatgtgccttaaagtttccaaatcgtcagtgccttacaacagtaattgatataagcggaaaaactgtttttatcacacgttatctcaaacctttaaaccctcctcaggagctccttaatgtctaccccaataatctacaggcaactgcagaactggtggctcgatatgtgtccttgattcccttcttgcctgacactgtctcatttggtggtatctgtgacctctggagcacatctgatcaatttcttgatctcctggcaggggatgaagaagaacatgcagtactattgtgtaattactttctgtctctgggtaagaaggcctggctgttgatgggcaatgctattcctgagggtccaactgcctatgtgctaacttgggagcaaggtcgttatttaatatggaatccctgcagtggacatttttatggacaatttgatacattctgtcccttgaaaaatgtgggctgtttaataggtcctgacaatatttggtttaatattcaacgatatgaatctccactaaggataaattttgatgtcaccaggcccaagctatggaaatctttcttttcaagaagccttccatatcctggcctttccagtgttcagcctgaagagctaatttaccagcgctcagacaaagcagctgcagctgagctacaagacaggattgaaaaaatactaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaatttttttcactgtactttctgtatcatgtaaaaactacacttaggatatgagaaaattttaaattatatgcatcacatcagaagaacatattattggcaaataataaaattatcaactgttttcaaactgtg

SEQ ID NO: 6323 - DNA, 630 bp, Homo sapiens
ctagaatgcagaatctgcaaagtgccttttgtaaagtttcttaagctatattctaatggatatgggctgacattaacaaggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagaagccaactcctttctcccgagcctgctggcagatcctcccccacctctccgcaggagttcccctcctaggctgggagcatcccgtgcagggtaaatcttttcaagccaccaactgctgtccccaaggaaatggtgtccgaaaaatcccaccttggcaacccccaggagcctgtgcaggaggagcccaagacccgcctcctgagtatgacagtccggagaggcccacggagagagctggttgttaaaaagagcctgggcaggccaggcacggtgactcacgtctgtaatcccagcactttggaaggccgaggcgggtaaatcacctgaggttgggagttcaagaccagcctgaccaacatggagaaaccccatctctactaaaaatacaaaaaaattagccaggcgtggt

SEQ ID NO: 6324 - DNA, 5031 bp, Homo sapiens
cttaggaacgggttgctaagctggtgtttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaaggtaaatcagtccctatgttctttgtcagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagaagccaactcctttctcccgagcctgctggcagatcctcccccacctctccgcaggagttcccctcctaggctgggagcatcccgtgcagggtaaatcttttcaagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaaagggccaagaagaagaaaaggaaacaagcagcagaagaacatcccggtgatgagattgcagagccgtatcccgaggaggaccttgtgaagcccagccctccagagcccactgatcgggcagtgatagagcaggaggtgagggagagagcagcccagagcaggaggaggccttgggagcccacgctggtcccggagctaagcctggcaggaagcgtaacacccaatgaccagtgccccagagcggaggtctcgagaagggaggatgtaaagaagcgctcagtgtacttaaaagtgctgttcaacaacaaggaggtgtccaggacagtcagtcggccactaggagcagacttccgagttcactttgggcagattttcaatttgcaaatagtcaactggccggagagtttaacacttcaggtctatgaaactgtcggacacagtagtcccaccttgctagcagaagtgtttctgcctattcctgagactactgttgtcactggaagggctcctactgaagaagtggagtttagcagtaatcagcatgtgacactggaccacgagggagttggaagtggagtgcccttctcatttgaagctgatggcagtaaccagctgactctgatgacctcagggaaagtgtctcatagtgtggcatgggccattggagaaaacgggatacctttaattcctccattgtcacagcagaacatcggatttcggagtgctttgaagaaagcagatgccatctcatctattggcacatcaggactgacagacatgaaaaaattggccaagtgggcagcagagtccaagctcgacccaaatgaccccaacaatgcccctttgatgcagcttatctcggttgctaccagtggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctccagcaggttagagaatcagtgataaatcgtttcttaattgcaaaacaatattttcttcttgctgatatgatagtagaagaagaagttcccaatatcagcattttgggcctaagccttttcaagctggcagaacaaaagcgaccactgcggccaaggagaaaaggtcggaagaaggtgacagcccaaaacctgtctgatggagacataaagctgctggtgaacattgtgcgagcttacgacattccagtgaggaagccggcagtgagcaaattccagcagccgtcgaggtcttcaaggatgttcagtgaaaagcatgctgcttccccaagcacgtacagcccaacccacaatgctgactaccccctcggccaggttttagtacgtccctttgtagaagtctcttttcaacgaacagtttgccatacgactacggctgaaggaccaaaccctagctggaatgaagaactagaacttccatttagggctcctaatggagattatagcacagccagtctgcagtcagtgaaagatgttgtgttcattaacatttttgatgaagtactgcatgatgtcttagaggatgaccgtgaaagaggaagtggaatccatactcgtattgagagacactggctgggatgtgtgaaaatgccatttagcacaatatatttccaagcaaggtttgagtctcaggaagatgagaaattacttcaagcaactgagaagtttcaagctgaatgtgccttaaagtttccaaatcgtcagtgccttacaacagtaattgatataagcggaaaaactgtttttatcacacgttatctcaaacctttaaaccctcctcaggagctccttaatgtctaccccaataatctacaggcaactgcagaactggtggctcgatatgtgtccttgattcccttcttgcctgacactgtctcatttggtggtatctgtgacctctggagcacatctgatcaatttcttgatctcctggcaggggatgaagaagaacatgcagtactattgtgtaattactttctgtctctgggtaagaaggcctggctgttgatgggcaatgctattcctgagggtccaactgcctatgtgctaacttgggagcaaggtcgttatttaatatggaatccctgcagtggacatttttatggacaatttgatacattctgtcccttgaaaaatgtgggctgtttaataggtcctgacaatatttggtttaatattcaacgatatgaatctccactaaggataaattttgatgtcaccaggcccaagctatggaaatctttcttttcaagaagccttccatatcctggcctttccagtgttcagcctgaagagctaatttaccagcgctcagacaaagcagctgcagctgagctacaagacaggattgaaaaaatactaaaagaaaaaatcatggactggaggccacgccatctgactcggtggaataggtattgtacctctactctgcgtcacttcttgcctctgttagaaaaaagtcaaggagaagatgtagaagatgaccacagagcagaactgctaaaacagctgggagactacaggttctctggatttcctcttcacatgccttattctgaagtgaagcctttaattgacgctgtgtatagtactggagtacataatattgatgttcctaatgttgaatttgctttagctgtatacatacacccataccccaaaaatgttttgtctgtttggatctatgttgcctctcttatacgcaacaggtaa

SEQ ID NO: 6325 - DNA, 1659 bp, Homo sapiens
tttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagaagccaactcctttctcccgagcctgctggcagatcctcccccacctctccgcaggagttcccctcctaggctgggagcatcccgtgcagggtaaatcttttcaagccaccaactgctgtccccaaggaaatggtgtccgaaaaatcccaccttggcaacccccaggagcctgtgcaggaggagcccaagacccgcctcctgagtatgacagtccggagaggcccacggagagagctggttgttaaaaagagcctgggcaggccaggcacggtgactcacgtctgtaatcccagcactttggaaggccgaggcgggtaaatcacctgaggttgggagttcaagaccagcctgaccaacatggagaaaccccatctctactaaaaatacaaaaaaattagccaggcgtggtggcgcatgcctgtaatcccagctacttgggaggctgaggcatgagaattgcttgaacctgggaggtggaggttgcagtgagccgagatcggagcactgcactccagcctaggcaacagagcaagactccatctcagaaaacaaacaaacaaaaaagagcctggaacctcctcccctctctcttgctccctctctcaccatgcgacacacctgtttccccttccccttctgacataagtgaaagcttcctaaggcctcaccagaggcagatgctggcaccatgcttattgcacagtctgcagaacagtgagccaaaataaacctcttttctttataaattacccagtctcagatattcctttatagcaatgcaaaatggactaacaatacataagttagggagtgttaattagaatggaaattaaatatgcagaaactcaaaggaagatgaaattgttagggaagacatatgtgttaacctagtgaggcttgaatcagatgtttggaagaaatgagggaggtttctgaggctcctggtgaccttgccattgaggacacatatacttctccccctacacacgccttttcttcttccccagtacaatgaacattaggaattacctgctcattgtagggaaaatgaccacccttcaggcattgcttttcatgaaaagtggattagacaagaggagaagtggttacactttttaattgttacataattgttagactgttttccctatggcaaagttgggaaataagtaactgttggaaactagaggcctttggaagcaagtagactcttagattggaaaaatgtggttctaatctaaaagcaatgatacaatgagagctgttatgaattaataaaaacagaaccaaaatttatctcatatggctgtttctttttctaaatgctcaaaattatttattactaccaaa

SEQ ID NO: 6326 - DNA, 1949 bp, Homo sapiens
tttttgctccaagacatggctgcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagcttacctccaattccttcaacttccagaacaggctttgcagaattttccatgaggggacgcatgagggagaaattgcaagcagcgaggtccaaagcagaaagtgcattgctgcaggaaatccccactcctcggcccagacgcttacgaagtcccagtaagaaagaattggagactgaatttggcacagagccagggaaagaggtagaaaggactcaacaagaagttgactcccaaagttactcaagagtcaagttccatgattctgcacgaaaaatcaagcctaaaccccaggttccacctggcttcccttctgcagaagaggcctataacttctttactttcaactttgatcccgaaccagaaggatcagaggaaaaaccaaaagcaagacatagagcgggaactaatcaagaggaggaggaaggggaagaagaagaaccacctgcacaaggaggaggaaaggaaatggatgaggaagaactgcttaatggtgatgatgccgaggacttcctattgggcttagatcacgtggctgacgattttgtagcagtcagacctgcagattatgaaagcatccatgatcggctgcagatggaaagagaaatgctcttcatacccagtaggcagacagtccctacatataaaaagcttcctgagaatgtacagcccaggttcctggaagatgaaggcctttacaccggggtaagaccagaggtggcacgcaccaatcagaacatcatggagaacagattgctgatgcaggaccccgaaagaagatggtttggagatgacggcaggatcctagctctgccaaaccccatcaagccatttccttcaaggccgccagtactaacacaggagcagagcattaaggcagagcttgaaacactgtataaaaaggctgtaaaatacgttcacagtagtcagcatgtgatcagatctggagaccctcctggaaatttccaactggacattgatatttcagggttaatcttcactcatcatccctgttttagccgagagcatgttttggcagccaagctggcccagttatatgaccagtaccttgcaagacaccagagaaacaaggcgaaatttcttactgataagctccaagctttaagaaatgctgttcagactggccttgatccagaaaaacctcatcagtctctcgataccatccaaaaaaccatcaatgagtataaatctgaaattcgacaaacaagaaaattccgtgatgctgaacaagaaaaagatagaacattgcttaagactatcataaaagtttggaaagagatgaaatcccttcgagagttccagagatttacaaatactcccttgaaacttgttttgagaaaggaaaaagctgaccagaaagcagatgaagaagcatatgaagcagaaattcaagctgaaataagtgaactgttagaagagcacacggaggagtacgcacagaagatggaagaatacagaacgtcgttacaacagtggaaggcctggaggaaagtgcaa

SEQ ID NO: 6327 - DNA, 1474 bp, Homo sapiens
gcagcttcccagggaggagcccaggggcatctccaacactcagcctttccctccggacccttttaaaagattcaacagcaccgtctctctccacttccatcctagaatgcagaatctgcaaagtgccttttgtaaagtttcttaagggacccatcccagccaaaatgaatcccagggaagaaaaagtaaaaataattacagaggagttcattgaaaatgatgaggatgcagacatgggaagacagaataagaactcaaaggttcgaagacagccaagaaagaaacagccaccaactgctgtccccaaggaaatggtgtccgaaaaatcccaccttggcaacccccaggagcctgtgcaggaggagcccaagacccgcctcctgagtatgacagtccggagaggcccacggagagagctggttgttaaaaagagcctgggcaggccaggcacggtgactcacgtctgtaatcccagcactttggaaggccgaggcgggtaaatcacctgaggttgggagttcaagaccagcctgaccaacatggagaaaccccatctctactaaaaatacaaaaaaattagccaggcgtggtggcgcatgcctgtaatcccagctacttgggaggctgaggcatgagaattgcttgaacctgggaggtggaggttgcagtgagccgagatcggagcactgcactccagcctaggcaacagagcaagactccatctcagaaaacaaacaaacaaaaaagagcctggaacctcctcccctctctcttgctccctctctcaccatgcgacacacctgtttccccttccccttctgacataagtgaaagcttcctaaggcctcaccagaggcagatgctggcaccatgcttattgcacagtctgcagaacagtgagccaaaataaacctcttttctttataaattacccagtctcagatattcctttatagcaatgcaaaatggactaacaatacataagttagggagtgttaattagaatggaaattaaatatgcagaaactcaaaggaagatgaaattgttagggaagacatatgtgttaacctagtgaggcttgaatcagatgtttggaagaaatgagggaggtttctgaggctcctggtgaccttgccattgaggacacatatacttctccccctacacacgccttttcttcttccccagtacaatgaacattaggaattacctgctcattgtagggaaaatgaccacccttcaggcattgcttttcatgaaaagtggattagacaagaggagaagtggttacactttttaattgttacataattgttagactgttttccctatggcaaagttgggaaataagtaactgttggaaactagaggcctttggaagcaagtagactcttagattggaaaaatgtggttctaatctaaaagcaatgatacaatgagagctgttatgaattaataaaaacagaaccaaaa

SEQ ID NO: 6328 - DNA, 1153 bp, Homo sapiens
cgcgcgactacgctcataaaaggaaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccaggaagagcgttcgcggagcgaacacaacttagtgaacatccagaagacccatgagcggatgcagacagagaacaagatttctccctattaccggacaaagctgcgtggcctctacacaaccgccaaggccgatgcagaggctgagtgcaacatccttcggaaagctctggacaagatcgcggaaatcaagtctctgttggaagagaggcggattgcggccaagattgccggtctctacaatgactcggagccaccccggaagaccatgcgcagaggggtgctgatgaccctgctgcagcagtcggccatgaccctgcccctgtggatcgggaagcctggtgacaagcccccacccctctgtggggccatccctgcctcaggagactacgtggccagacctggagacaaggtggctgcccgggtgaaggccgtggatggggacgagcagtggatcctggccgaggtggtcagttacagccatgccaccaacaagtatgaggtagatgacatcgatgaagaaggcaaagagagacacaccctgagccggcgccgtgtcatcccgctgccccagtggaaggccaacccggagacggaccctgaggccttgttccagaaggagcagctcgtgctggccctgtatccccagactacctgcttctaccgcgccctgatccatgcgcccccacagcggccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattccccctcta

SEQ ID NO: 6329 - DNA, 1993 bp, Homo sapiens
ggctggggaggagcaggaacagtcaggactggaatctagctttgctccaaagccagctcttaattaccaacatggggatgggggtggcgtgttcctggccctcattttccgggagaggggtaactcccccgattttggcccccacatccctgagaaccttggggtctggctgtaggaggtaggggagctctgaggggtccgcgctggctagttcctgagagagcgttaaaagtagattctcctttcgctccaactttctcggtgtctcaaacactctcctgccttctgggcccattgggcacaccgccacccaatccggggacccccggagactcgccagctctccaggatgggaatttcgtgatgttccctgcctgagcttcggggagggcgggggagtgctgtaaggggctatcgcgcaagtgcagaccctctgcttctgccgcaaacggcgggcctcacctggacccggggactcttcaacgaggggcgctagcctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcggtgcccctgaggccctcggctgctggggtccgtaggaagccgcgccatgaatgaccggagcagtcggaggcggacaatgaaggacgatgagaccttcgagatctccattcccttcgatgaggcaccccacctagacccacagatcttttacagtctgagcccctctcggagaaacttcgaggagcctccggaggctgcgtcctccgccctggctctgatgaacagcgtcaagacccagctgcacatggctctggagaggaactcctggctgcagaagcgcatcgaggacctggaggaagagagggacttcctgcggtgccagctggacaaattcatctcttctgctcggatggaggcagaggaccactgccggatgaagcctgggcccaggcggatggagggggacagccgtggtggggctgggggcgaggcctcggaccctgagtcagcagcctcctccctcagcggagcgtccgaagaaggcagcgccagtgagaggaggcggcagaagcagaagggaggtgctagtcggaggcgctttgggaagcccaaggcccgggagaggcagcgagtgaaggacgccgacggggtcctctgccggtacaagaagatcctgggcaccttccagaagctcaagagcatgtcgcgggccttcgagcaccaccgcgtggacaggaacaccgtggcgctgaccacgcccatcgccgagctgctcattgtggcccccgagaagctggccgaggtgggcgagttcgacccctccaaggagcgcctgctcgagtactcccgccgctgctttctggccctggacgacgagacgctcaagaaggtgcaggcgctcaagaagagcaagctgctgctgcccatcacctaccgcttcaagcggtgatcgcaccacgcctccgcgcctccacccgggccttcctcccccgtggaccccggtggatgacctgcccctctccccgccgcgcccctgcccctcctcctcgctccctgggttgggggctcccttagccgggcccccaagcgcgacggccccggaccggccgcggccccttcccgaacgccggcacccccttccgcttgggctgcccagccctgtcctcgccgggccccttcctcctggaaaaccaggcaggcgggtgcccccccctcgagtgggggactgtacagaccccgtctccgccctggccccgcggaggagctgcccacctgattcccggacagacctccccaactccgcgtgagacagagaattattcagataatttaaattaaaaaacgacgtgaaaatttggaataaa

SEQ ID NO: 6330 - DNA, 2259 bp, Homo sapiens
gtcctgtatctatggagacggcaatatggaggcgatcttacatttctttgatttcatctgaacgtccagttcacaattggagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggtaccagtataagggatcaaggacccagtgccacagccttgagccccgaaagcaggctctcttcaaaacaaaacaaaacaaacaaaaaaaacctttaacatgccatataaaagccagtgagtgtttaaaatacgtgcagtatgaataattatgcagctataatccattatttttcattgtggtatagtgtcccaatgtgtgcctgtaccataatgtattcatccagaatgaaggaagtttgggctgtttctatttgggactgttggcattcgtgtatatgtgtccagttacataagtacaagagtttttctggggaataccaggtactatgaaggctcacgtgattttggagtcttatgaaggttttttttttttttttcctgcgtagttgttaaattggtgaccttgcgggatggaaccttctattccaccaccttgctccaccttctgtcttttctggggaatagacgcaggagtagaattgcggaggcttgggccatgtacctgttcacttgctgtagataaaccaaactatttcccaaagtgcatggatttctttagacacccaccagcagcattagagagttcccattcctccacatccttaccaataactgctattgtcagaatttaaaatttttgccagtaatggtaacttgtggttttaatttgcatttccctgattactaatgaatgaggatgagtgtctttttgtaggttattgacactttgcatttcttcatgtgtgaaatttatgatcaagtctgtggccatttttctcttacattatcttgtcttttttctttttggtataagttcttatcccaattacaaactctttgccagttatgcgttgtggatatcttctctcatcttatgatttgtctttactccctttattgtgtcttttgaagaataaaagttcaaagttgaattttaaaggtatcaactttatcagtctttttattttatgattggtgcttttttatgcttctcctaagaagtccttctctacccctaggtcattaagatattttcctctagtatcttctaaagactttatatttttgccttttatatttgtcttttgtctatatggaattgatttttatgaatagtaagtcttgatagctggtagtatacgtcctcctacttaattcttcttcaagattgtcttggctattcttggccctccctttgatctcttacataaatattcaaatcagcttatcatacatgcacataaaacacttcttgagattttgattgggatttaattggacctatagatgaatatgaggagaaatgatatcattataatattgagtcttttactccatgaacatgggctatttctgtattcattaggttatctttcctgtctctcaatagagtgtaaagttttctccatagacatttagcacatccttagttagatttattcataagtattttatatttttgctgttgttatatatgacatattttttagttgttttatttctgtttgttgctagtttttaaaatgtcatttttatataggtattatgttcagtgatcttggcaaatcctcttattctaataatttatttgttaattttcttgttttttcatgcacacatttgtattttaaatggaaaatgacatttttttttctttctagtccttacacctttggctttccttactgcattgttaaatagaaaagtgttgaacagaagtggttatagaggcatctttgttttgtttatcatctcagagtaaaggactgcaatgtttcactattaa

SEQ ID NO: 6331 - DNA, 1174 bp, Homo sapiens
ggaaaacagacatgtatgcatacatagcatctggcatatacatagcatctggcatatatacaaatatatgtgccacatatatttgcatatgatttcagctacagtcatcgaggatccctctgctctggagatggattgacttatgctttgattgatttatttcagtgatgtttaccttaaccggttgtagactggtggagaaaacccagaaggtggagaatccatcagtctcatttgcctcttctttcccccttattcctcttctcctaagaggcaagagtgttcagaagaaacaagcagagagtaaaagccagataaaggtaatgcacacacttcagtaacacccactggagcttgctgagcagtgccaagtgtggccatggaggggcctagtggggtgggccttgtccccaagtccctctttggagtgccttccctgagggtgagtccctgggctcccaggcaaagccctggatctcgtgtacagcctcattcctcatggtgccaggtagcacctgttgccagagctgggaagcagaccctctcctccatgacaaggatggccatgagagtctcctccctcagcctctctttctcatgtcactcctgtctcctctcccctctgctctcttcccagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggtaccagtataagggatcaaggacccagtgccacagccttgagccccgaaagcaggctctcttcaaaacaaaacaaaacaaacaaaaaaaacctttaacatgccatataaaagccagtgagtgtttaaaatacgtgcagtatgaataa

SEQ ID NO: 6332 - DNA, 5953 bp, Homo sapiens
gtcctgtatctatggagacggcaatatggaggcgatcttacatttctttgatttcatctgaacgtccagttcacaattggagtgatgtttaccttaaccggttgtagactggtggagaaaacccagaaggtggagaatccatcagtctcatttgcctcttctttcccccttattcctcttctcctaagaggcaagagtgttcagaagaaacaagcagagagtaaaagccagataaagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggccccccaagaccaagttcttcttcacggtcatccctcagcccatcttcctgagcccaggcataaccctcacgctccccatcgtcttccggcctctggaggcgaaggagtacatggaccagctgtggtttgagaaagcggaggggatgttctgtgtcggcctacgggccaccctgccctgccacaggctgatctgccgcccaccatccctgcagctgcccatgtgtgctgtgggagatacgactgaggcctttttctgcctggataatgtgggggacctgcccaccttcttcacctgggagttctccagcccattccagatgctgcccgccacggggctcctggagccaggccaggcctctcagatcaaggtgacctttcagccccttacagccgtcatctacgaggtgcaggccacgtgctggtacggggcgggcagccggcagaggagcagcatccagctgcaggctgtggccaagtgcgcccagctgctggtgagcataaagcacaagtgcccggaggaccaggatgccgagggcttccagaagctgttgtactttggctctgttgctgtgggctgcacctcggagaggcagatcaggctacacaacccgtcggcggtaaatgcccccttcaggattgaaatttccccggatgaactggccgaagaccaggccttctcatgccccacggcccatggcatcgtgcttccgggagagaagaaatgtgtgtcggtgttcttccaccccaagactctggacaccagaactgtggactactgctccatcatgccttctggctgtgcctccaagaccctgcttaaagtcgttggtttctgtagaggccctgctgtgtccctgcagcactactgtgtcaacttcagctgggtcaaccttggggagcgctccgagcagcccctgtggattgagaaccaatcggactgcacggcccacttccagtttgccatcgactgcttggagagtgtctttaccatcaggcctgcctttgggacgctggtgggcaaggcccgtatgaccctgcactgtgccttccagcccactcaccccatcatctgctttcggcgtgtggcctgtctcatccaccaccaggacccactgttcctggacctgatggggacctgccactcggacagcaccaagccagccatcctgaagcctcagcacctcacctggtaccgcacacacctggcccggggcctgacgctctacccccctgacatcctggatgccatgctgaaggagaagaagctggcacaggaccagaacggggctctcatgattcccatccaggatctggaggacatgccggccccgcagtacccttatatcccccccatgaccgagttcttcttcgacggcaccagcgacataaccatcttccccccgcccatcagtgtagagcctgtcgaggtagacttcggtgcctgcccagggcctgaggcccccaaccctgtacccctgtgcctgatgaaccacaccaagggcaagatcatggtggtctggacgcgaaggtctgactgccccttctgggtgactccagagagctgcgacgtgcccccactcaagtccatggccatgcgcctgcacttccagccgcctcaccccaactgcctttacacggtggagctcgaagccttcgccatctataaggtcctgcagagctacagtaatattgaggaggactgcaccatgtgcccatcctggtgcctgacggtgcgggcacgaggccacagctatttcgctggctttgagcaccacatcccccagtattccctagatgtccccaagctatttccagcagtgtcctccggtgagcccacctaccgcagcctgctcctggtcaacaaagactgcaagctgctgaccttcagcctggccccccagagaggctcagacgtcatccttcggcccacttcgggccttgtggcacccggggcccaccagatcatcctcatctgcacctaccctgagggcagctcctggaagcagcacactttctatctgcagtgcaatgcttccccccagtatctcaaggaggtgagcatgtacagccgggaggagccactgcagctgaagctggacacccacaaaagcctctacttcaagcccacctgggtgggctgctcctccaccagccccttcaccttccgcaacccctcgcgtctgcccctgcagttcgagtggagggtctctgagcagcatcgaaagctgctggctgtccagccctccagggggctaatccagcccaacgagagacttacgctgacgtggaccttcagccctttggaggagaccaagtacctgttccaagtggggatgtgggtctgggaagccggcctgtccccaaatgccaaccccgctgccaccacccactacatgctccggctggtgggcgttgggctcaccagcagcctctctgcaaaggaaaaggagctggcctttgggaatgtgctggtgaacagcaagcagtccaggttccttgtcctcctgaatgacggcaactgcaccctctattaccgcctctacctggagcagggcagccctgaggccgttgacaaccaccccctcgctctgcagctggaccgaacagaggggagcatgccaccccggtcccaggacaccatctgcctgactgcctgtcccaagcagcggtcccagtactcctggaccatcacctactctctcctttcccacagagataacaaggctggggagaagcaggagctgtgctgcgtctccctggtggccgtgtaccccttgctttccatcctggatgtcagctccatgggcagtgctgagggtatcacccggaagcacctgtggcgcctcttctctctggacctgcttaacagttacttggagcgtgaccccaccccctgtgagctcacctacaaggtgcccacccggcacagcatgagccagatcccccccgtcctcacccctttaaggcttgacttcaatttcggggccgcaccattcaaggccccaccttccgtggtattcctggccctgaagaacagcggagtggtgtccctggactgggccttcctccttccaagtgaccagcggattgacgtggagctctgggcagagcaagcagagttgaattccactgagctccaccagatgcgcgtgcaggacaattgcctcttctccatcagccccaaggctgggagcctgagtcctgggcaggagcagatggtggagttaaaatacagccacctgttcatcggtactgatcacctcccagtgctcttcaaggtgtcccatggccgggagatcctgctaaatttcataggtgtgacagtgaagccggagcagaagtatgtgcacttcacctctactacccaccagttcatccccattcccattggtgacacgctacccccacggcagatttatgagctgtataatggtggctcagtgcccgtgacatatgaggtccagaccgatgtcctgtcacaggttcaggaaaaaaattttgatcaccccatcttttgctgcctcaaccccaaaggggagatccagccaggcagcactgcccgggtcttgtggatcttctcacctatcgaggccaagacctacacggtggacgtgcccatacacatcctgggatggaactcggccctcatccacttccagggagtgggctacaacccccatatgatgggggacacagccccattccacaacatctcctcgtgggacaacagttccatacactctaggctggtggtgcctggacagaatgtcttcctgtcccagtctcatatttccctgggaaacatacctgtgcagagcaagtgcagccgcctgctcttcctcaacaacatctccaagaacgaggaaattgccttctcctggcagccaagtcctctagattttggggaggtgtctgtgagtcccatgataggggtggtggctcctgaagagacggtcccatttgtggtgaccttgagggcctctgtgcatgccagcttctacagtgcagacctggtatgcaagctgtactcgcagcagctcatgaggcagtatcacaaggagctgcaggagtggaaggacgagaaggtgcggcaggaagtggagttcaccatcaccgacatgaaagtgaagaagagaacatgctgcacagcctgtgaacctgcgaggaagtacaagacactgcctcccatcaagaaccagcagtctgtcagccggcctgccagctggaaactgcagaccccaaaggaggaggtgtcctggccctgcccccagccaccctcgccaggcatgctctgcctgggccttactgcccgagcccatgccaccgactactttctggctaacttcttctcagagtttccctgccactttttgcaccgggagctgccaaagaggaaggcccccagggaagagtcagagacttctgaggaaaaatcccctaacaagtggggccctgtttccaagcagaagaagcagctcctggttgacattctcaccacaataatcaggggcctgctggaagacaagaacttccatgaggctgtggaccaaagcctggtggagcaggtgccgtacttccgccaattctggaatgagcagtcaactaagttcatggaccagaaaaacagcctgtacttaatgccaatcctgcctgtaccctccagcagctgggaggatgggaagggcaagcagccgaaggaagacagaccagagcactatccagggttgggaaagaaggaagagggggaggaggagaagggtgaagaggaagaagaagagttggaggaggaagaggaggaagaagaggagacagaagaggaggagttgggcaaggaggagatagaggagaaggaggaggagagggatgagaaggaagagaaagtgagctgggcgggcatcgggcccacaccacagcctgagtcccaggagtccatgcaatggcagtggcaacagcagctgaatgtcatggtgaaggaggagcaagaacaggacgagaaggaggccatcagaaggctcccggccttcgccaacctgcaggaggcgctgctggagaacatgatccagaacatcctggtggaggcgagccgcggggaggtggtactcacctcgcggccacgcgtcatcgccctgccgccgttctgcgtgcccaggagtctgaccccggacacgctgctgccgacgcagcaagcagaggtactccacccggtggtgccacttcctaccgaccttccgtaaatgcccgcgcccagcctctccgacatgccgctaggggtcacgcctggccccctctccaccgccagtaaaagcatctagtcttttttctgta

SEQ ID NO: 6333 - DNA, 2701 bp, Homo sapiens
atctatggagacggcaatatggaggcgatgtaagttctgagcgttagtcccaaggtcccagggtctcagggagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggccccccaagaccaagttcttcttcacggtcatccctcagcccatcttcctgagcccaggcataaccctcacgctccccatcgtcttccggcctctggaggcgaaggagtacatggaccagctgtggtttgagaaagcggaggggatgttctgtgtcggcctacgggccaccctgccctgccacaggctgatctgccgcccaccatccctgcagctgcccatgtgtgctgtgggagatacgactgaggcctttttctgcctggataatgtgggggacctgcccaccttcttcacctgggagttctccagcccattccagatgctgcccgccacggggctcctggagccaggccaggcctctcagatcaaggtgacctttcagccccttacagccgtcatctacgaggtgcaggccacgtgctggtacggggcgggcagccggcagaggagcagcatccagctgcaggctgtggccaagtgcgcccagctgctggtgagcataaagcacaagtgcccggaggaccaggatgccgagggcttccagaagctgttgtactttggctctgttgctgtgggctgcacctcggagaggcagatcaggctacacaacccgtcggcggtaaatgcccccttcaggattgaaatttccccggatgaactggccgaagaccaggccttctcatgccccacggcccatggcatcgtgcttccgggagagaagaaatgtgtgtcggtgttcttccaccccaagactctggacaccagaactgtggactactgctccatcatgccttctggctgtgcctccaagaccctgcttaaagtcgttggtttctgtagaggccctgctgtgtccctgcagcactactgtgtcaacttcagctgggtcaaccttggggagcgctccgagcagcccctgtggattgagaaccaatcggactgcacggcccacttccagtttgccatcgactgcttggagagtgtctttaccatcaggcctgcctttgggacgctggtgggcaaggcccgtatgaccctgcactgtgccttccagcccactcaccccatcatctgctttcggcgtgtggcctgtctcatccaccaccaggacccactgttcctggacctgatggggacctgccactcggacagcaccaagccagccatcctgaagcctcagcacctcacctggtaccgcacacacctggcccggggcctgacgctctacccccctgacatcctggatgccatgctgaaggagaagaagctggcacaggaccagaacggggctctcatgattcccatccaggatctggaggacatgccggccccgcagtacccttatatcccccccatgaccgagttcttcttcgacggcaccagcgacataaccatcttccccccgcccatcagtgtagagcctgtcgaggtagacttcggtgcctgcccagggcctgaggcccccaaccctgtacccctgtgcctgatgaaccacaccaagggcaagatcatggtggtctggacgcgaaggtctgactgccccttctgggtgactccagagagctgcgacgtgcccccactcaagtccatggccatgcgcctgcacttccagccgcctcaccccaactgcctttacacggtggagctcgaagccttcgccatctataaggtgtgtgcacgcaatgagagggaggaatgcggggtctctgctaggagcctgagtggcttggtggggtggcaggaagtgaccgagggcagcttcaggctccatcctctgcgtgccaggctttctcttggctggacagtgacccctatgagtttgtctcctccaaagctcctggcctagctcggcccatctgattttctcattcttatgtaagtctcccctcccctccaagggagaactcagctgagatcaagctgtttgggaaaactgggtgcacagggagatactccctggggctcctggctaggaggcctcctagcttctctactagtccttgaattaagaagtggtcactctaaaggagctttgagcgggcaggaagctgggcctagagacaaagtcagcagcaccagataattgtgatggaaagggcttctgactcagcttccctgggtcgggaactccgagtgccggctgtccccagccctgctgttctggccccagatgcgtggtgccccctcctcatccgttagtcctgcccatcccttccttcttgactctgcccaccccact

SEQ ID NO: 6334 - DNA, 5945 bp, Homo sapiens
gtcctgtatctatggagacggcaatatggaggcgatgtaagttctgagcgttagtcccaaggtcccagggtctcaatttcagtgatgtttaccttaaccggttgtagactggtggagaaaacccagaaggtggagaatccatcagtctcatttgcctcttctttcccccttattcctcttctcctaagaggcaagagtgttcagaagaaacaagcagagagtaaaagccagataaagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggccccccaagaccaagttcttcttcacggtcatccctcagcccatcttcctgagcccaggcataaccctcacgctccccatcgtcttccggcctctggaggcgaaggagtacatggaccagctgtggtttgagaaagcggaggggatgttctgtgtcggcctacgggccaccctgccctgccacaggctgatctgccgcccaccatccctgcagctgcccatgtgtgctgtgggagatacgactgaggcctttttctgcctggataatgtgggggacctgcccaccttcttcacctgggagttctccagcccattccagatgctgcccgccacggggctcctggagccaggccaggcctctcagatcaaggtgacctttcagccccttacagccgtcatctacgaggtgcaggccacgtgctggtacggggcgggcagccggcagaggagcagcatccagctgcaggctgtggccaagtgcgcccagctgctggtgagcataaagcacaagtgcccggaggaccaggatgccgagggcttccagaagctgttgtactttggctctgttgctgtgggctgcacctcggagaggcagatcaggctacacaacccgtcggcggtaaatgcccccttcaggattgaaatttccccggatgaactggccgaagaccaggccttctcatgccccacggcccatggcatcgtgcttccgggagagaagaaatgtgtgtcggtgttcttccaccccaagactctggacaccagaactgtggactactgctccatcatgccttctggctgtgcctccaagaccctgcttaaagtcgttggtttctgtagaggccctgctgtgtccctgcagcactactgtgtcaacttcagctgggtcaaccttggggagcgctccgagcagcccctgtggattgagaaccaatcggactgcacggcccacttccagtttgccatcgactgcttggagagtgtctttaccatcaggcctgcctttgggacgctggtgggcaaggcccgtatgaccctgcactgtgccttccagcccactcaccccatcatctgctttcggcgtgtggcctgtctcatccaccaccaggacccactgttcctggacctgatggggacctgccactcggacagcaccaagccagccatcctgaagcctcagcacctcacctggtaccgcacacacctggcccggggcctgacgctctacccccctgacatcctggatgccatgctgaaggagaagaagctggcacaggaccagaacggggctctcatgattcccatccaggatctggaggacatgccggccccgcagtacccttatatcccccccatgaccgagttcttcttcgacggcaccagcgacataaccatcttccccccgcccatcagtgtagagcctgtcgaggtagacttcggtgcctgcccagggcctgaggcccccaaccctgtacccctgtgcctgatgaaccacaccaagggcaagatcatggtggtctggacgcgaaggtctgactgccccttctgggtgactccagagagctgcgacgtgcccccactcaagtccatggccatgcgcctgcacttccagccgcctcaccccaactgcctttacacggtggagctcgaagccttcgccatctataaggtcctgcagagctacagtaatattgaggaggactgcaccatgtgcccatcctggtgcctgacggtgcgggcacgaggccacagctatttcgctggctttgagcaccacatcccccagtattccctagatgtccccaagctatttccagcagtgtcctccggtgagcccacctaccgcagcctgctcctggtcaacaaagactgcaagctgctgaccttcagcctggccccccagagaggctcagacgtcatccttcggcccacttcgggccttgtggcacccggggcccaccagatcatcctcatctgcacctaccctgagggcagctcctggaagcagcacactttctatctgcagtgcaatgcttccccccagtatctcaaggaggtgagcatgtacagccgggaggagccactgcagctgaagctggacacccacaaaagcctctacttcaagcccacctgggtgggctgctcctccaccagccccttcaccttccgcaacccctcgcgtctgcccctgcagttcgagtggagggtctctgagcagcatcgaaagctgctggctgtccagccctccagggggctaatccagcccaacgagagacttacgctgacgtggaccttcagccctttggaggagaccaagtacctgttccaagtggggatgtgggtctgggaagccggcctgtccccaaatgccaaccccgctgccaccacccactacatgctccggctggtgggcgttgggctcaccagcagcctctctgcaaaggaaaaggagctggcctttgggaatgtgctggtgaacagcaagcagtccaggttccttgtcctcctgaatgacggcaactgcaccctctattaccgcctctacctggagcagggcagccctgaggccgttgacaaccaccccctcgctctgcagctggaccgaacagaggggagcatgccaccccggtcccaggacaccatctgcctgactgcctgtcccaagcagcggtcccagtactcctggaccatcacctactctctcctttcccacagagataacaaggctggggagaagcaggagctgtgctgcgtctccctggtggccgtgtaccccttgctttccatcctggatgtcagctccatgggcagtgctgagggtatcacccggaagcacctgtggcgcctcttctctctggacctgcttaacagttacttggagcgtgaccccaccccctgtgagctcacctacaaggtgcccacccggcacagcatgagccagatcccccccgtcctcacccctttaaggcttgacttcaatttcggggccgcaccattcaaggccccaccttccgtggtattcctggccctgaagaacagcggagtggtgtccctggactgggccttcctccttccaagtgaccagcggattgacgtggagctctgggcagagcaagcagagttgaattccactgagctccaccagatgcgcgtgcaggacaattgcctcttctccatcagccccaaggctgggagcctgagtcctgggcaggagcagatggtggagttaaaatacagccacctgttcatcggtactgatcacctcccagtgctcttcaaggtgtcccatggccgggagatcctgctaaatttcataggtgtgacagtgaagccggagcagaagtatgtgcacttcacctctactacccaccagttcatccccattcccattggtgacacgctacccccacggcagatttatgagctgtataatggtggctcagtgcccgtgacatatgaggtccagaccgatgtcctgtcacaggttcaggaaaaaaattttgatcaccccatcttttgctgcctcaaccccaaaggggagatccagccaggcagcactgcccgggtcttgtggatcttctcacctatcgaggccaagacctacacggtggacgtgcccatacacatcctgggatggaactcggccctcatccacttccagggagtgggctacaacccccatatgatgggggacacagccccattccacaacatctcctcgtgggacaacagttccatacactctaggctggtggtgcctggacagaatgtcttcctgtcccagtctcatatttccctgggaaacatacctgtgcagagcaagtgcagccgcctgctcttcctcaacaacatctccaagaacgaggaaattgccttctcctggcagccaagtcctctagattttggggaggtgtctgtgagtcccatgataggggtggtggctcctgaagagacggtcccatttgtggtgaccttgagggcctctgtgcatgccagcttctacagtgcagacctggtatgcaagctgtactcgcagcagctcatgaggcagtatcacaaggagctgcaggagtggaaggacgagaaggtgcggcaggaagtggagttcaccatcaccgacatgaaagtgaagaagagaacatgctgcacagcctgtgaacctgcgaggaagtacaagacactgcctcccatcaagaaccagcagtctgtcagccggcctgccagctggaaactgcagaccccaaaggaggaggtgtcctggccctgcccccagccaccctcgccaggcatgctctgcctgggccttactgcccgagcccatgccaccgactactttctggctaacttcttctcagagtttccctgccactttttgcaccgggagctgccaaagaggaaggcccccagggaagagtcagagacttctgaggaaaaatcccctaacaagtggggccctgtttccaagcagaagaagcagctcctggttgacattctcaccacaataatcaggggcctgctggaagacaagaacttccatgaggctgtggaccaaagcctggtggagcaggtgccgtacttccgccaattctggaatgagcagtcaactaagttcatggaccagaaaaacagcctgtacttaatgccaatcctgcctgtaccctccagcagctgggaggatgggaagggcaagcagccgaaggaagacagaccagagcactatccagggttgggaaagaaggaagagggggaggaggagaagggtgaagaggaagaagaagagttggaggaggaagaggaggaagaagaggagacagaagaggaggagttgggcaaggaggagatagaggagaaggaggaggagagggatgagaaggaagagaaagtgagctgggcgggcatcgggcccacaccacagcctgagtcccaggagtccatgcaatggcagtggcaacagcagctgaatgtcatggtgaaggaggagcaagaacaggacgagaaggaggccatcagaaggctcccggccttcgccaacctgcaggaggcgctgctggagaacatgatccagaacatcctggtggaggcgagccgcggggaggtggtactcacctcgcggccacgcgtcatcgccctgccgccgttctgcgtgcccaggagtctgaccccggacacgctgctgccgacgcagcaagcagaggtactccacccggtggtgccacttcctaccgaccttccgtaaatgcccgcgcccagcctctccgacatgccgctaggggtcacgcctggccccctctccaccgccagtaaaagcatctagtcttt

SEQ ID NO: 6335 - DNA, 5870 bp, Homo sapiens
atttcagtgatgtttaccttaaccggttgtagactggtggagaaaacccagaaggtggagaatccatcagtctcatttgcctcttctttcccccttattcctcttctcctaagaggcaagagtgttcagaagaaacaagcagagagtaaaagccagataaagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggccccccaagaccaagttcttcttcacggtcatccctcagcccatcttcctgagcccaggcataaccctcacgctccccatcgtcttccggcctctggaggcgaaggagtacatggaccagctgtggtttgagaaagcggaggggatgttctgtgtcggcctacgggccaccctgccctgccacaggctgatctgccgcccaccatccctgcagctgcccatgtgtgctgtgggagatacgactgaggcctttttctgcctggataatgtgggggacctgcccaccttcttcacctgggagttctccagcccattccagatgctgcccgccacggggctcctggagccaggccaggcctctcagatcaaggtgacctttcagccccttacagccgtcatctacgaggtgcaggccacgtgctggtacggggcgggcagccggcagaggagcagcatccagctgcaggctgtggccaagtgcgcccagctgctggtgagcataaagcacaagtgcccggaggaccaggatgccgagggcttccagaagctgttgtactttggctctgttgctgtgggctgcacctcggagaggcagatcaggctacacaacccgtcggcggtaaatgcccccttcaggattgaaatttccccggatgaactggccgaagaccaggccttctcatgccccacggcccatggcatcgtgcttccgggagagaagaaatgtgtgtcggtgttcttccaccccaagactctggacaccagaactgtggactactgctccatcatgccttctggctgtgcctccaagaccctgcttaaagtcgttggtttctgtagaggccctgctgtgtccctgcagcactactgtgtcaacttcagctgggtcaaccttggggagcgctccgagcagcccctgtggattgagaaccaatcggactgcacggcccacttccagtttgccatcgactgcttggagagtgtctttaccatcaggcctgcctttgggacgctggtgggcaaggcccgtatgaccctgcactgtgccttccagcccactcaccccatcatctgctttcggcgtgtggcctgtctcatccaccaccaggacccactgttcctggacctgatggggacctgccactcggacagcaccaagccagccatcctgaagcctcagcacctcacctggtaccgcacacacctggcccggggcctgacgctctacccccctgacatcctggatgccatgctgaaggagaagaagctggcacaggaccagaacggggctctcatgattcccatccaggatctggaggacatgccggccccgcagtacccttatatcccccccatgaccgagttcttcttcgacggcaccagcgacataaccatcttccccccgcccatcagtgtagagcctgtcgaggtagacttcggtgcctgcccagggcctgaggcccccaaccctgtacccctgtgcctgatgaaccacaccaagggcaagatcatggtggtctggacgcgaaggtctgactgccccttctgggtgactccagagagctgcgacgtgcccccactcaagtccatggccatgcgcctgcacttccagccgcctcaccccaactgcctttacacggtggagctcgaagccttcgccatctataaggtcctgcagagctacagtaatattgaggaggactgcaccatgtgcccatcctggtgcctgacggtgcgggcacgaggccacagctatttcgctggctttgagcaccacatcccccagtattccctagatgtccccaagctatttccagcagtgtcctccggtgagcccacctaccgcagcctgctcctggtcaacaaagactgcaagctgctgaccttcagcctggccccccagagaggctcagacgtcatccttcggcccacttcgggccttgtggcacccggggcccaccagatcatcctcatctgcacctaccctgagggcagctcctggaagcagcacactttctatctgcagtgcaatgcttccccccagtatctcaaggaggtgagcatgtacagccgggaggagccactgcagctgaagctggacacccacaaaagcctctacttcaagcccacctgggtgggctgctcctccaccagccccttcaccttccgcaacccctcgcgtctgcccctgcagttcgagtggagggtctctgagcagcatcgaaagctgctggctgtccagccctccagggggctaatccagcccaacgagagacttacgctgacgtggaccttcagccctttggaggagaccaagtacctgttccaagtggggatgtgggtctgggaagccggcctgtccccaaatgccaaccccgctgccaccacccactacatgctccggctggtgggcgttgggctcaccagcagcctctctgcaaaggaaaaggagctggcctttgggaatgtgctggtgaacagcaagcagtccaggttccttgtcctcctgaatgacggcaactgcaccctctattaccgcctctacctggagcagggcagccctgaggccgttgacaaccaccccctcgctctgcagctggaccgaacagaggggagcatgccaccccggtcccaggacaccatctgcctgactgcctgtcccaagcagcggtcccagtactcctggaccatcacctactctctcctttcccacagagataacaaggctggggagaagcaggagctgtgctgcgtctccctggtggccgtgtaccccttgctttccatcctggatgtcagctccatgggcagtgctgagggtatcacccggaagcacctgtggcgcctcttctctctggacctgcttaacagttacttggagcgtgaccccaccccctgtgagctcacctacaaggtgcccacccggcacagcatgagccagatcccccccgtcctcacccctttaaggcttgacttcaatttcggggccgcaccattcaaggccccaccttccgtggtattcctggccctgaagaacagcggagtggtgtccctggactgggccttcctccttccaagtgaccagcggattgacgtggagctctgggcagagcaagcagagttgaattccactgagctccaccagatgcgcgtgcaggacaattgcctcttctccatcagccccaaggctgggagcctgagtcctgggcaggagcagatggtggagttaaaatacagccacctgttcatcggtactgatcacctcccagtgctcttcaaggtgtcccatggccgggagatcctgctaaatttcataggtgtgacagtgaagccggagcagaagtatgtgcacttcacctctactacccaccagttcatccccattcccattggtgacacgctacccccacggcagatttatgagctgtataatggtggctcagtgcccgtgacatatgaggtccagaccgatgtcctgtcacaggttcaggaaaaaaattttgatcaccccatcttttgctgcctcaaccccaaaggggagatccagccaggcagcactgcccgggtcttgtggatcttctcacctatcgaggccaagacctacacggtggacgtgcccatacacatcctgggatggaactcggccctcatccacttccagggagtgggctacaacccccatatgatgggggacacagccccattccacaacatctcctcgtgggacaacagttccatacactctaggctggtggtgcctggacagaatgtcttcctgtcccagtctcatatttccctgggaaacatacctgtgcagagcaagtgcagccgcctgctcttcctcaacaacatctccaagaacgaggaaattgccttctcctggcagccaagtcctctagattttggggaggtgtctgtgagtcccatgataggggtggtggctcctgaagagacggtcccatttgtggtgaccttgagggcctctgtgcatgccagcttctacagtgcagacctggtatgcaagctgtactcgcagcagctcatgaggcagtatcacaaggagctgcaggagtggaaggacgagaaggtgcggcaggaagtggagttcaccatcaccgacatgaaagtgaagaagagaacatgctgcacagcctgtgaacctgcgaggaagtacaagacactgcctcccatcaagaaccagcagtctgtcagccggcctgccagctggaaactgcagaccccaaaggaggaggtgtcctggccctgcccccagccaccctcgccaggcatgctctgcctgggccttactgcccgagcccatgccaccgactactttctggctaacttcttctcagagtttccctgccactttttgcaccgggagctgccaaagaggaaggcccccagggaagagtcagagacttctgaggaaaaatcccctaacaagtggggccctgtttccaagcagaagaagcagctcctggttgacattctcaccacaataatcaggggcctgctggaagacaagaacttccatgaggctgtggaccaaagcctggtggagcaggtgccgtacttccgccaattctggaatgagcagtcaactaagttcatggaccagaaaaacagcctgtacttaatgccaatcctgcctgtaccctccagcagctgggaggatgggaagggcaagcagccgaaggaagacagaccagagcactatccagggttgggaaagaaggaagagggggaggaggagaagggtgaagaggaagaagaagagttggaggaggaagaggaggaagaagaggagacagaagaggaggagttgggcaaggaggagatagaggagaaggaggaggagagggatgagaaggaagagaaagtgagctgggcgggcatcgggcccacaccacagcctgagtcccaggagtccatgcaatggcagtggcaacagcagctgaatgtcatggtgaaggaggagcaagaacaggacgagaaggaggccatcagaaggctcccggccttcgccaacctgcaggaggcgctgctggagaacatgatccagaacatcctggtggaggcgagccgcggggaggtggtactcacctcgcggccacgcgtcatcgccctgccgccgttctgcgtgcccaggagtctgaccccggacacgctgctgccgacgcagcaagcagaggtactccacccggtggtgccacttcctaccgaccttccgtaaatgcccgcgcccagcctctccgacatgccgctaggggtcacgcctggccccctctccaccgccagtaaaagcatctagtcttt

SEQ ID NO: 6336 - DNA, 3438 bp, Homo sapiens
gcgcgtcctgtatctatggagacggcaatatggaggcgatgtaagttctgagcgttagtcccaaggtcccagggtctcagggagaggcaagagtgttcagaagaaacaagcagagagtaaaagccagataaagctccatactcagagtgctccctttggactgtgtcccaaggacatgatgctcacccaggctccaagctccgtcgtgaggtccaggaacagcaggaaccacaccgtgaactctggtggatcctgcctgagtgccagcacagtggccatccctgccatcaacgacagcagtgcagccatgagtgcctgcagcaccatcagcgcccagcccgcaagctccatggacactcagatgcactccccaaagaagcaggagagagtgaacaagagggtcatctggggcattgaggtggctgaggagctgcattggaaaggctgggagctaggaaaggagaccacaaggaatctggttctgaaaaatcgatccttgaaactccagaagatgaagtacaggccccccaagaccaagttcttcttcacggtcatccctcagcccatcttcctgagcccaggcataaccctcacgctccccatcgtcttccggcctctggaggcgggacctgcccaccttcttcacctgggagttctccagcccattccagatgctgcccgccacggggctcctggagccaggccaggcctctcagatcaaggtgacctttcagccccttacagccgtcatctacgaggtgcaggccacgtgctggtacggggcgggcagccggcagaggagcagcatccagctgcaggctgtggccaagtgcgcccagctgctggtgagcataaagcacaagtgcccggaggaccaggatgccgagggcttccagaagctgttgtactttggctctgttgctgtgggctgcacctcggagaggcagatcaggctacacaacccgtcggcggtaaatgcccccttcaggattgaaatttccccggatgaactggccgaagaccaggccttctcatgccccacggcccatggcatcgtgcttccgggagagaagaaatgtgtgtcggtgttcttccaccccaagactctggacaccagaactgtggactactgctccatcatgccttctggctgtgcctccaagaccctgcttaaagtcgttggtttctgtagaggtaccggtgaccccaggggcctcccctggggacaggagcagcccctgctgaggattctgaagagctccttccctgctcctaggaggcggggccaccttgcctcagcctgggtgtctgctgccccctggtggccctgtggggaatcatccgtgactacctggagatcccagtcccactggcatccagtgatgctggagttctgctcaggctgccagggctctgggcctgtagcctggccctgagagtaccacctcccttcagtggaactttgtctaagatatccttggggaagctgataccccatctcctgtgtccaggccctgctgtgtccctgcagcactactgtgtcaacttcagctgggtcaaccttggggagcgctccgagcagcccctgtggattgagaaccaatcggactgcacggcccacttccagtttgccatcgactgcttggagagtgtctttaccatcaggcctgcctttgggacgctggtgggcaaggcccgtatgaccctgcactgtgccttccagcccactcaccccatcatctgctttcggcgtgtggcctgtctcatccaccaccaggacccactgttcctggacctgatggggacctgccactcggacagcaccaagccagccatcctgaagcctcagcacctcacctggtaccgcacacacctggcccggggcctgacgctctacccccctgacatcctggatgccatgctgaaggagaagaagctggcacaggaccagaacggggctctcatgattcccatccaggatctggaggacatgccggccccgcagtacccttatatcccccccatgaccgagttcttcttcgacggcaccagcgacataaccatcttccccccgcccatcagtgtagagcctgtcgaggtagacttcggtgcctgcccagggcctgaggcccccaaccctgtacccctgtgcctgatgaaccacaccaagggcaagatcatggtggtctggacgcgaaggtctgactgccccttctgggtgactccagagagctgcgacgtgcccccactcaagtccatggccatgcgcctgcacttccagccgcctcaccccaactgcctttacacggtggagctcgaagccttcgccatctataaggtgtgtgcacgcaatgagagggaggaatgcggggtctctgctaggagcctgagtggcttggtggggtggcaggaagtgaccgagggcagcttcaggctccatcctctgcgtgccaggctttctcttggctggacagtgacccctatgagtttgtctcctccaaagctcctggcctagctcggcccatctgattttctcattcttatgtaagtctcccctcccctccaagggagaactcagctgagatcaagctgtttgggaaaactgggtgcacagggagatactccctggggctcctggctaggaggcctcctagcttctctactagtccttgaattaagaagtggtcactctaaaggagctttgagcgggcaggaagctgggcctagagacaaagtcagcagcaccagataattgtgatggaaagggcttctgactcagcttccctgggtcgggaactccgagtgccggctgtccccagccctgctgttctggccccagatgcgtggtgccccctcctcatccgttagtcctgcccatcccttccttcttgactctgcccaccccactgcccttgcccagaggccaaggtcttggggcccagagaaaagtagggctgtgcggtcaagatcagggtcacttaccagctatgtgaccttgggcaagttccttaatgtctctgagtcctgatcttttcatctctaaacttgggaccacgtccgatcttttgaggaggctttccaaagtggaggctttggttgcccccgtcctaatgctctggcagtggggtgatgttgaggtttgtaggaataaggttgtagatgcctggctctgctgaggttcagcctgtcagatatttaggttacaggctctagacctgcacagtccagtacagccactgacagccacacgtggctactgagcttttaatatgtggctggtcccaattgagacgtgccgtgagtgtaaaatgcaccctggatttcaagacttagtatgaaaagaatgtaaaatacctcgttactaattttatattggttatatgttaaagtgataagattttagatctgttgggttaaataaaatatactattaacatt

SEQ ID NO: 6337 - DNA, 1646 bp, Homo sapiens
acttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggaggtgtgtccatggcggcgcttgacctgcgagcggagctggattcgctggtcctgcagctgcttggggacctggaggagctggaggggaaacgaacggtgttgaacgcccgggtggaggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtgatctcaggccttcttccttcacaattagctcttgcccctaccccacgccagctaatgccccttctgtgtccctgctctgcatgtttccattttccttaggtgtgaagtttgaagaggcaaacagtaattttgaaagccactactttgaaaccattctaaggcctgagttcccataggacacactcacataggcaggtacacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccactacccaa

SEQ ID NO: 6338 - DNA, 1430 bp, Homo sapiens
aattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatggtgtcctggaggccaagaagagaaagtgtttcctggagcgagtgatccaatgtgtggtcagccctgctgctgaacaggaggccgaagacgagagctgcccggaggactgggcagcagctgttccagcagagacatcagcaaaagccatctagaggtggatccagagtgtggactaacagagaaaagaagtggagggagagcaggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtgatctcaggccttcttccttcacaattagctcttgcccctaccccacgccagctaatgccccttctgtgtccctgctctgcatgtttccattttccttaggtgtgaagtttgaagaggcaaacagtaattttgaaagccactactttgaaaccattctaaggcctgagttcccataggacacactcacataggcaggtacacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataaga

SEQ ID NO: 6339 - DNA, 1281 bp, Homo sapiens
attgcctggccagaaaaggaagtaatccctagtgtcagcagattcagcggtactggtgtataataggatcaccaatatacaacaggaaaaaacaaaagtgaaagattatcaatatagattattgagtaggagtaaagaaggtaaatcaaaaaggggaaaagagattacagacacagaaaatgtcagacaacaaagaaaggaagagtcaaggatttcctaaagaagataaccaagacacaagttcattagctgatgctgtagagaaagttgcaaagcaacaacaatcacaagcatcagagatagaaaaaaacaaaaaggttctgttcaatttgaagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggaagacattacaaacttaaaggataaaattataactgtaaaagaatctatcattgaaaaaacttgttttcttgaggaagaaaaaaagacacatgaaaaattaagaaaagaaatagagagtctcgccccatcgcccaggctagagtgcagtagtgcaatctcggctcactgcaagctctgcctcccaggttcacgccattctcctgcctcagcctccggagtagctgggactacaggcgcctgccaccacacccagctaattttttgcatttttagtagagacggggtttcaccatgttagccaggatggtcttgatctcctgacctcatgatccacccgcctcggcctcccaaagtgttgggattacaggcgtgagccaccgcgcccagccttaatttaacttttaagttcaggggtatgtatgcaggtttgttatataggtaaatttctgtcatagtttgttgtacagattatttcaatagccaggtattaagcctagtacccattagttatttttcctgatcctttccctcctctcaccctccag

SEQ ID NO: 6340 - DNA, 1118 bp, Homo sapiens
tcccaggggaaacctgacggccaggttccctcgtgccagctgccgggaggcgggagggagtgccctgaaactctaatctcattgcctggccagaaaaggaagtaatccctagtgtcagcagattcagcggtactggtgtataataggatcaccaatatacaacaggaaaaaacaaaagtgaaagattatcaatatagattattgagtaggagtaaagaaggtaaatcaaaaaggggaaaagagattacagacacagaaaatgtcagacaacaaagaaaggaagagtcaaggatttcctaaagaagataaccaagacacaagttcattagctgatgctgtagagaaagttgcaaagcaacaacaatcacaagcatcagagatagaaaaaaacaaaaaggttctgttcaatttgaagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggaagacattacaaacttaaaggataaaattataactgtaaaagaatctatcattgaaaaaacttgttttcttgaggaagaaaaaaagacacatgaaaaattaagaaaagaaatagaggtacaacataagaggtatgatgcaattcttaagcgtttgcattgtcaggtgaacaagcttcagtcaaatagacgacagtggcaatggaacattcaacaattggaaaaaactgcagccgaattaagaaaatgcattggaatgcaagagtaacattgccatagggcaatgtggaacacagaccatgaca

SEQ ID NO: 6341 - DNA, 4198 bp, Homo sapiens
tgagctggagtccgggctccggtccccgccacggaccttgagagggtacccggggtcagacctggcagacagcccattttttcttatgataaagacggcatttggctcatgagcaaggtggcaagatcatcaagtgagtcagacgtgcagctctgggaaacagaagaggatgacatgacagaaggtgatttagggtatggcctcggaaggaaacctggtgggatttatgaaatagaattttcacataggtctagaaaaagatcagatggaaagaactttagccctcctccatttccgagaaagggagaagaaagaaatgaagcgagttttcagtattccaagcataagagccagcaagatacattccctcaagtgtccagaatttccaattacagacgacaaagtagcactgtagattcgaattcagaattgtcaaatgaagaattaaggcaatgtcttaatgaaactttagaggaggtagaaatgttaaaaactgaacttgaggcatctcaaagacaactcagaggtaaagaggaagcattgaaaattcttcaaagcatggcaatactgggcaaagccacaagtcatacgcaggcagtgcttcaaaaaactatggaacaaaacagatccttggagaaggaaataaatgccttgcagtgggaaatagaatttgatcataatagatttaaaaatatagaggaatcttggatccaaaaatatgacaggctaaactgtgaaaatgcagtcctcaaagagaatttgaaagtgaaaacagaagaaattaaaatgctgaagtctgacaatgcagttttgaatcaacggtatttggaggccctcgccatgcttgatatcaaacagcagaagatggctcaggaaaacatgtgctgtgataaaagtggctttgcagaggcttcaggtcttgagcttgcggtcctcggagcctgcctttgtcatgggcccggagggaacccctgttcttgtgccagaatggcagcatccactcggaaactgcttcttcagctcaaacaagagttggaaattttgcagaagagtaaagaagaagcttacgtgatggcagatgctttcagaattgcatttgagcaacaattaatgagaaaaaatgaccaggcactacaattgacacaaatggataaaatgcataaaaaagcaacaaaatggatgaattggaagcaccttaaagaggatggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgtaagacttcagaattctctgttttgggtgatcctatacattcaagtgtctgcattttaaattctgtgggctgcatttgttcaatccagcactctcaaatagatccaaactatagaactcttaaaagatcccattctttgccatcaagtatcatattttaaagacaagccagttgaaattggaactgagagttgtttatatcgagatactttgaaaaatgattttgtaaattttgctgcatcttgagaagttgtatgtttcctaggtatttctaaattttaggaggtcacttaaatcaaatattttctacattttctttttcttcttttgagatggagtcttgctctgtcacccaggttggagtgcagtggtgtgatctcggttcactgcaacctccgcctcccggttcaagcaattctcctgcctcagcctcccgagtaactcggattacaggcatgtgccaccacgcccagctaatttttgtatttttagtagagacggggttttaccatgttagccaggctgatcttgaactcctgacctcaagtgatccgcctgccttggcctccgaaagtgctgggattacaggcgtgagccaccacacccagcctattttctacattttctacaagaaattagtattctgtgttgacattttatttataaattacattactgtatttataaattacattacaggctgggcatggtggctcatgcttataaatcccagcactttgggaggccaaggtgggtgggtcacctgaggctggagttcaagaccagtctgaccaacatggagaaaccccatctctactaaaaatacaaaaaattagctaggcctagtggcgcatgcctgtaatcccagctacttgggaggctgaggtaggagaatcgcttgaacctgggaggcgggggttgtggtaagccgagactgtgtcattgcactccagcctgggcgacaagagcgaaactctgtctcaaaaaaaaaaaaaaacacattacagtgtttgccaacatcctaaaacaaaaaataatgatttttgggaaaaacaaaaaattatttaactattttgattgactatagggatcttagcttggctaaatcaacaatatagcaatgtatcttaatgctctaaaaagtaacaatacctaggactgactgaatgttaatttctggaattcatttatcttgttttatttgccttgttcagtatttttcatttaccatatgaagtttagaaataacaatttccttaagttaacttcaataagacagttttgatggtgggaccttggcagaagtatattgagtcagtgccggctgcgttcatggcttcttgtcagggtagtaacattttgcaaccaaatctgcacagatttgtagccaagtctacaaagtgcttaacagctcttttcattgcatcctgtgagatggttgtgatgatccaggaaatggggtctcaggaatctgaagaagctgcctgagccaaggtgatttctaggagtttttttgtttgtggtatgtgaattggggtgtgtgggggtggggtgtgtgtgtagacagggtcccactgtgttgctcaggctggtgccaaactcctggcctcaagggatcctcctgcctcagcctctcaaagtgctgggattacaggcataaaccacaactcaataaaaaagtttttaaaaatttacaaagctcatatttgatccagctaggattttaccctgtacatttgtatttcttgtaggctggcgcacagatatcttaaatggctactaattgctgctgtgtatgaaaacaaatggctatcaaggccgggtgcagtggcttacagatctggtctgaatctcaagtccagaccagtccagagttcaagaccagcctgggcaacatggtgaaaccccatctatacaaaaactcggcaaggcatggtggcatgcacctgttgtcccagctactcaggggctgaggcaggaggatggcatgagcccaggagcttgaggctgcagtgagctgtgattgtgccactgcactccagcctgagtgacagagtgagacccccatctccaaaagaaaaggctatcaatacaaaagtttatctaaattactgtacagctatacaatggaatactctacaaaatggagagatccataagataaagcaaatgaataaagcaaaatgcatgtgttgacagctgttgtgatacctcagttcttgtcttcttggtttaaaagaatttaaatgagacagcaaaggagatgcagcataatttattgcaaaagaaaaggagtattttgaaagttaggtgcagaacagacagtacacctgagagagagaattcagggccggctgctcgtaagggtgagacagcattgattattgctggagaaactccctttatgggagttttgcattattattcataaggaggtgaggtgttgcagtaatcatgtcctgggtggtcctctgcacaggtgcagtagctgttaatgcttgttcatacaccacatgtctcagtagcatcttaaatttccacctagaggtgtgttttttattattatcatgtgcaaaggatcagtttgaggacaggtaaaatcaaaatgtgtatgctctctagaagggaaagtccctactgaagatagctttgcttaaatgagctcaattacaatgtgaatgctgaggtttattgtgttggctgtatggtcatgag

SEQ ID NO: 6342 - DNA, 3613 bp, Homo sapiens
cagacagcccattttttcttatgataaagacggcatttggctcatgagcaaggtggcaagatcatcaagtgagtcagacgtgcagctctgggaaacagaagaggatgacatgacagaaggtgatttagggtatggcctcggaaggaaacctggtgggatttatgaaatagaattttcacataggtctagaaaaagatcagatggaaagaactttagccctcctccatttccgagaaagggagaagaaagaaatgaagcgagttttcagtattccaagcataagagccagcaagatacattccctcaagtgtccagaatttccaattacagacgacaaagtagcactgtagattcgaattcagaattgtcaaatgaagaattaaggcaatgtcttaatgaaactttagaggaggtagaaatgttaaaaactgaacttgaggcatctcaaagacaactcagaggtaaagaggaagcattgaaaattcttcaaagcatggcaatactgggcaaagccacaagtcatacgcaggcagtgcttcaaaaaactatggaacaaaacagatccttggagaaggaaataaatgccttgcagtgggaaatagaatttgatcataatagatttaaaaatatagaggaatcttggatccaaaaatatgacaggctaaactgtgaaaatgcagtcctcaaagagaatttgaaagtgaaaacagaagaaattaaaatgctgaagtctgacaatgcagttttgaatcaacggtatttggaggccctcgccatgcttgatatcaaacagcagaagatggctcaggaaaacatgtgctgtgataaaagtggctttgcagaggcttcaggtcttgagcttgcggtcctcggagcctgcctttgtcatgggcccggagggaacccctgttcttgtgccagaatggcagcatccactcggaaactgcttcttcagctcaaacaagagttggaaattttgcagaagagtaaagaagaagcttacgtgatggcagatgctttcagaattgcatttgagcaacaattaatgagaaaaaatgaccaggcactacaattgacacaaatggataaaatgcataaaaaagcaacaaaatggatgaattggaagcaccttaaagaggatggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgtaagacttcagaattctctgttttgggtgatcctatacattcaagtgtctgcattttaaattctgtgggctgcatttgttcaatccagcactctcaaatagatccaaactatagaactcttaaaagatcccattctttgccatcaagtatcatattttaaagacaagccagttgaaattggaactgagagttgtttatatcgagatactttgaaaaatgattttgtaaattttgctgcatcttgagaagttgtatgtttcctaggtatttctaaattttaggaggtcacttaaatcaaatattttctacattttctttttcttcttttgagatggagtcttgctctgtcacccaggttggagtgcagtggtgtgatctcggttcactgcaacctccgcctcccggttcaagcaattctcctgcctcagcctcccgagtaactcggattacaggcatgtgccaccacgcccagctaatttttgtatttttagtagagacggggttttaccatgttagccaggctgatcttgaactcctgacctcaagtgatccgcctgccttggcctccgaaagtgctgggattacaggcgtgagccaccacacccagcctattttctacattttctacaagaaattagtattctgtgttgacattttatttataaattacattactgtatttataaattacattacaggctgggcatggtggctcatgcttataaatcccagcactttgggaggccaaggtgggtgggtcacctgaggctggagttcaagaccagtctgaccaacatggagaaaccccatctctactaaaaatacaaaaaattagctaggcctagtggcgcatgcctgtaatcccagctacttgggaggctgaggtaggagaatcgcttgaacctgggaggcgggggttgtggtaagccgagactgtgtcattgcactccagcctgggcgacaagagcgaaactctgtctcaaaaaaaaaaaaaaacacattacagtgtttgccaacatcctaaaacaaaaaataatgatttttgggaaaaacaaaaaattatttaactattttgattgactatagggatcttagcttggctaaatcaacaatatagcaatgtatcttaatgctctaaaaagtaacaatacctaggactgactgaatgttaatttctggaattcatttatcttgttttatttgccttgttcagtatttttcatttaccatatgaagtttagaaataacaatttccttaagttaacttcaataagacagttttgatggtgggaccttggcagaagtatattgagtcagtgccggctgcgttcatggcttcttgtcagggtagtaacattttgcaaccaaatctgcacagatttgtagccaagtctacaaagtgcttaacagctcttttcattgcatcctgtgagatggttgtgatgatccaggaaatggggtctcaggaatctgaagaagctgcctgagccaaggtgatttctaggagtttttttgtttgtggtatgtgaattggggtgtgtgggggtggggtgtgtgtgtagacagggtcccactgtgttgctcaggctggtgccaaactcctggcctcaagggatcctcctgcctcagcctctcaaagtgctgggattacaggcataaaccacaactcaataaaaaagtttttaaaaatttacaaagctcatatttgatccagctaggattttaccctgtacatttgtatttcttgtaggctggcgcacagatatcttaaatggctactaattgctgctgtgtatgaaaacaaatggctatcaaggccgggtgcagtggcttacagatctggtctgaatctcaagtccagaccagtccagagttcaagaccagcctgggcaacatggtgaaaccccatctatacaaaaactcggcaaggcatggtggcatgcacctgttgtcccagctactcaggggctgaggcaggaggatggcatgagcccaggagcttgaggctgcagtgagctgtgattgtgccactgcactccagcctgagtgacagagtgagacccccatctccaaaagaaaaggctatcaatacaaaagtttatctaaattactgtacagctatacaatggaatactctacaaaatggagagatccataagataaagcaaatgaataaagcaaaatgcatgtgttg

SEQ ID NO: 6343 - DNA, 1735 bp, Homo sapiens
acgcgcacggagaggaggctacttgccagacagcccattttttcttatgataaagacggcatttggctcatgagcaaggtggcaagatcatcaagtgagtcagacgtgcagctctgggaaacagaagaggatgacatgacagaagggagaagaaagaaatgaagcgagttttcagtattccaagcataagagccagcaagatacattccctcaagtgtccagaatttccaattacagacgacaaagtagcactgattcgaattcagaattgtcaaatgaagaattaaggcaatgtcttaatgaaactttagaggaggtagaaatgttaaaaactgaacttgaggcatctcaaagacaactcagaggtaaagaggaagcattgaaaattcttcaaagcatggcaatactgggcaaagccacaagtcatacgcaggcagtgcttcaaaaaactatggaacaaaacagatccttggagaaggaaataaatgccttgcagtgggaaatagaatttgatcataatagatttaaaaatatagaggaatcttggatccaaaaatatgacaggctaaactgtgaaaatgcagtcctcaaagagaatttgaaagtgaaaacagaagaaattaaaatgctgaagtctgacaatgcagttttgaatcaacggtatttggaggccctcgccatgcttgatatcaaacagcagaagatggctcaggaaaacatgtgctgtgataaaagtggctttgcagaggcttcaggtcttgagcttgcggtcctcggagcctgcctttgtcatgggcccggagggaacccctgttcttgtgccagaatggcagcatccactcggaaactgcttcttcagctcaaacaagagttggaaattttgcagaagagtaaagaagaagcttacgtgatggcagatgctttcagaattgcatttgagcaacaattaatgagaaaaaatgaccaggcactacaattgacacaaatggataaaatgcataaaaaagcaacaaaatggatgaattggaagcaccttaaagaggatggatttccatcaccaaggagtaagaagaccttcgggcagagactgttgggtatgctcccttcagaaaacagttctaagaggatggaagaccaggacagtcctcaagaggtccttaagatgctcatagatttgcttaatgataaagaagaagctttggctcatcaaagaaaagttagctacatgcttgctcgggcattggaagacaaagacactgcttcaaacgagaataaagaaaaaaatcctataaaagagaatttccctttcaacaacccctggcgtaagacttcagaattctctgttttgggtgatcctatacattcaagtgtctgcattttaaattctgtgggctgcatttgttcaatccagcactctcaaatagatccaaactatagaactcttaaaagatcccattctttgccatcaagtatcatattttaaagacaagccagttgaaattggaactgagagttgtttatatcgagatactttgaaaaatgattttgtaaattttgctgcatcttgagaagttgtatgtttcctaggtatttctaaattttaggaggtcacttaaatcaaatattttctacattttctttttcttcttttgagatggagtcttgctctgtcacccaggttggagtgcagtggtgtgatctcggttcactgcaacctccgcctcccggttcaagc

SEQ ID NO: 6344 - DNA, 4169 bp, Homo sapiens
ccctgtccccccggactaaatacgcacaccccctctttctttctgtgcaagcaagagggtcctggaacagcgggttctgaggaggctgggaggcagggctgagaggtggccgagagagaggagtcgcagagccgccagagtgagtcaggcacctccactgggattacagatcccagagcctcgaggagctggaagacatgtccccttctttcctctgcaccccagcccgcagccagccccccaccccccagcccctcctttctccctgctctcaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagatcaaagaactgcagaccaagctgcgggagctgcagctgcaataccaggctagcatggatgagcaggggcggcttctggtagtgcaggagcagctggaggggcagctgcagtgctgccaggaggagctccgccagctcagggagaagaggccttctgttgtcaaagaagcccgggggaagaatgctaataagaacatgaacaagaatgccaatggggttaaaatgaaaaaggtgaccaagccatgctcggatacttctgagagcgaccttgagaccagaaagagtctggaggtagtgctgtactacaaggccagccagaggaaattagatggactagcaaaagaggaggaaaagaaagaggagatggaggaggaaaaaaagcaagtgaaagaggaagcaaaggagcagtgtggggatgagctagttgctgagccagcagatcctgaggaagctaaatccacagaagatcaggaggaaaatgaagaggacaaagaggaagaggagaaggaagaagacagtgaagaggaggaggatgacgccgactcttcccttgaaagtcccgaagaaaataaccccctcagactttccgagagcaaaaagtcatcccctacccccaatccccccatcttctccttgcctcttgtaggcctggtggtcatctcggctttgctctggtgctggtgggctgagacgtcgtcctaatgcagaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattaca

SEQ ID NO: 6345 - DNA, 3094 bp, Homo sapiens
ttgagggccctggaaggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattac

SEQ ID NO: 6346 - DNA, 1689 bp, Homo sapiens
gcggctgcggcttctgctcagggaggcggaaggcggcggcgggagcggtcatggaggcgggcgccggagccggcgcgggagccgcgggctggagctgcccgggcccaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccgaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagtcatcccctacccccaatccccccatcttctccttgcctcttgtaggcctggtggtcatctcggctttgctctggtgctggtgggctgagacgtcgtcctaatgcagaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaatt

SEQ ID NO: 6347 - DNA, 3694 bp, Homo sapiens
ttgagggccctggaaggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagatcaaagaactgcagaccaagctgcgggagctgcagctgcaataccaggctagcatggatgagcaggggcggcttctggtagtgcaggagcagctggaggggcagctgcagtgctgccaggaggagctccgccagctcagggagaagaggccttctgttgtcaaagaagcccgggggaagaatgctaataagaacatgaacaagaatgccaatggggttaaaatgaaaaaggtgaccaagccatgctcggatacttctgagagcgaccttgagaccagaaagagtctggaggtagtgctgtactacaaggccagccagaggaaattagatggactagcaaaagaggaggaaaagaaagaggagatggaggaggaaaaaaagcaagtgaaagaggaagcaaaggagcagtgtggggatgagctagttgctgagccagcagatcctgaggaagctaaatccacagaagatcaggaggaaaatgaagaggacaaagaggaagaggagaaggaagaagacagtgaagaggaggaggatgacgccgactcttcccttgaaagtcccgaagaaaataaccccctcagactttccgagagcaaaaagaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattac

SEQ ID NO: 6348 - DNA, 624 bp, Homo sapiens
cctccctgcgcacccggctcgggtccccgggctcgcggctgcggcttctgctcagggaggcggaaggcggcggcgggagcggtcatggaggcgggcgccggagccggcgcgggagccgcgggctggagctgcccgggcccagagggtcctggaacagcgggttctgaggaggctgggaggcagggctgagaggtggccgagagagaggagtcgcagagccgccagagacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccag

SEQ ID NO: 6349 - DNA, 1720 bp, Homo sapiens
gcggcttctgctcagggaggcggaaggcggcggcgggagcggtcatggaggcgggcgccggagccggcgcgggagccgcgggctggagctgcccgggcccaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagtcatcccctacccccaatccccccatcttctccttgcctcttgtaggcctggtggtcatctcggctttgctctggtgctggtgggctgagacgtcgtcctaatgcagaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaatta

SEQ ID NO: 6350 - DNA, 253 bp, Homo sapiens
tgctcagggaggcggaaggcggcggcgggagcggtcatggaggcgggcgccggagccggcgcgggagccgcgggctggagctgcccgggcccagcccgcagccagccccccaccccccagcccctcctttctccctgctctcaggacccacagtgaccactctaggctcctatgaggcttccgagggctgtgagaggaagaagggccaacgctgggggtccctggaacgacgggggatgcaagctatggaggg

SEQ ID NO: 6351 - DNA, 723 bp, Homo sapiens
gggggtcttccggccctgaggcttgatggggccaccggagggctcctcctaagagggtccttggccctggctcggtggggggtcgcggaaagcggagaggtcagggccctgccgttcgcccatccgggcctcgacttccctcctccggcccccaggctgccgaggggccaccgggcaggggtgggcagggcctggggccggagtcagcgcggactgctaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaag

SEQ ID NO: 6352 - DNA, 552 bp, Homo sapiens
agacccccaggtgctcccggcctccgcggctcccctttctccgcccaaagtcttcctccctccatcctggcctccaccggggcccggtctccatccttccggcctgggactgaggcttccgcgcaccggccgcatcctgcctggtggtccctccccagcgcgtctctccacttcagtccgacggtgcttccagccttcgggactgcagaccctacacctcctgcagccccggagactcctgagcgcggggcgagggtggggtgggcaaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctca

SEQ ID NO: 6353 - DNA, 2109 bp, Homo sapiens
ggaagtggcttcgctagggagcctcccggcgtggagatggcgggagctggtcgcggagcagcggtgtccagggtgcaggcgggtcctgggagtccccggcgagcgcgggggcggcagcaagtgcagccgctggggaagcagcgcccagccccgtggcccgggcttcgcagcaaagagaagaagaaagtgaactgcaagcccaagaaccaggacgaacaggagattcctttccggctccgggagattatgaggagccgccaagagatgaaaaacccgatcagtaacaagaagaggaagaaagcagcccaggtgaccttcagaaagacattggagaaggaagcaaagggagaggagcccgacatcgcagtccccaagttcaaacagaggaagggggagtctgacggggcctatatccaccgcatgcagcaagaggcccagcatgtgctgttcctcagcaagaaccaggccatccggcagccagaggtgcaggcagctcccaaggagaagtctgagcagaaaaaagcaaaaaaagcgttccagaagcggcgactagataaagtccgacggaaaaaggaggaaaaggcggcagacaggctggagcaggagttgctccgagacacggtgaagtttggtgaggttgtcctgcagcccccagagctgactgccaggccccagaggagcgtaagcaaggaccagcctggcaggagatcgcagatgctgcggatgcttctgagccccggtggtgtgtcccagcctctgaccgcctccctggcccgccagcggattgtggaggaggagagagagcgggccgtgcaggcctacagagcgttgaagcagcggcagcagcagctgcacggggagcgaccccacctcacttcccggaagaagccagagccgcagctgtgatggagagacacccggggcctggccacgctctggggcaactggcaccaggagctgctacacctgggtaggagagaggcaggccatgccagcagtgtggggtgaggcctccagctacttgttcacacgttgggcactagtgggtccacatcttgcagggggtgagtgcccgatggactagggccaaggcctggttgacagacggcccgtggggcccggtgtcactcacagctccatctctttgttttgaacgtccattctgagtctcagcccaggtggaccttaggaagggctggatccctgtccctgaacaccaaataccgagacagctgatgaggctggctcagtgtgtgacggaggcccccgggagtcagcagagccgagcgtacagtgcacatcaggcagagcaggccacgggcagggacgacgcatcgggacagggctctgcaggggaccgtgactacaggccagctgtgagtggtcccctacagaggctgcccacccaaggtttggttggggtgaaacatgatgacaacacatacacttaagaaggtgggaaccgggggccgggcgcggtggctcacacctgtaatgccagcactttgggcagctgaggcgagtggatcacctgaggtcaggagttcgaaccagcctggccaacatggtgaaactgcatctctactaaaaatacacgaagaaaaaaaaaacagtgggaacagagttgtcacctacctaacagggctctgagagagccgggaggcccaaagtggctggaagaaggtaaaggaaaaatcctgtcttgggctcaaggtcacagagtggggcccagggggagttcctgctgagggcagggccttgccaggcttcagtctccagtgccaaaggaggaaatgcccaggctgtcagcatttccagatgagagcagaagggagaagcttaaacccaagtcacacatccagcaatggagtccgacagcccagcaccatctgggaactgagaagcacctctgcccggcccccacaccgtgtggaaagtgaggagcacctctgcctggccgccaccccgtctggcaagtgaggagcgcctctgcccggccgctgtgcaaccttccaagtgtgaagtgacagccttgtgtgtgatgttttctgccttccccaagtttgcactttcgacattaaagtttactttttagttaaaagttttaaa

SEQ ID NO: 6354 - DNA, 1842 bp, Homo sapiens
cactagggccttggcggcgccgaggcggcagcagaagtccggagtcagggcgtgtggctgaggagatgccactaagcacagctggcatcctgagctcctcttctgccgcttccaacaggtcaaggaataaggctcgctatcggaccaaagccgtgagctctgaggtggatgagagcctctttggagatatcaagtccccagcccagggccagagcgacagccccattgtgctgctccgagataagcatacccttcaaaaaactctcactgctttgggcttggatcgcaagccagagaccatccagctcatcacccgggacatggtccgagaactcattgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggatgcagtgatgacacgaaagaagatcatgaaacagaaggagatggtgtggaacaacaacaagaagctcagtgacctggaggaggtggccaaggaacgggcccagaacctcctgcagagagccaacaagctgcggatggagcaggaggaggagctcaaggacatgagcaagattatcctcaatgctaagtgccatgccatccgggatgcccaaatcctggagaagcagcagatccaaaaagaactggacacagaagagaagcggttggatcagatgatggaagtggagcggcagaaatccattcaaaggcaggaggaactggagaggaagaggagggaggaaagaattagaggaaggcggcaaattgtggaacagatggaaaagaaccaggaggagcgatcgctgcttgctgagcagcgggagcaggagaaggagcagatgctggaatatatggaacagctccaagaggaagatctaaaggacatggaacgaaggcagcaacaaaaactgaagatgcaagctgagattaagcgcatcaatgatgaaaaccagaaacagaaagcagaactgctggctcaggagaagctggcagaccagatggtgatggagtttaccaagaagaagatggctcgagaagcagagtttgaggctgagcaggagagaatccggagggagaaagagaaggagatcgcacgcttgagggccatgcaggagaaggcccaggattaccaggcagaacaggatgccttgcgggccaagcgcaaccaggaggttgcagacagagagtggcgcagaaaggaaaaggaaaatgcgcggaagaagatggaaacagaggctgagctgcgaaaaagtcggctcgaacaggtggctttcaaggagcacgctctggctgttcaggtgcaacgggaccgggatgagttcgagaggattcttcgggctcagagagaacagattgagaaggagcggctggaggaggagaaaaaggccacagggcgcttacagcatgccaatgagctccggcgccaggtgcgcgagaaccagcagaaggaagtgcagaaccggattgccacctttgaggagggccggcgcctcaaagaggaggcccagaaacgccgtgagcgcatcgatgagatcaagaggaaaaagcttgaagagctgagagccactggccttcccgagaagtactgcattgaagctgagcgcaaagctaacatcctgccagctacctctgtgaactgaggggagccttcgtggccctcaggatgccttcgggggacagattctgcccagtctctgggcatccataattgctgctaacctagacatttcatagttacagattaaatctacttgactttaa

SEQ ID NO: 6355 - DNA, 1976 bp, Homo sapiens
gatggccaacttggtcccaattgaagaaagaggataattgcgtggatcactcagagtaaaaggcaaggggtctcgtgcatgggaatctccctttcttggtaaccaaagtctacagaaagggaagtagaaccaggccaagagtttgaagcctgaatttgccagcctgcggagactgtgcaaaagaagaactagatctcagaatggccactaagcacagctggcatcctgagctcctcttctgccgcttccaacaggtcaaggaataaggctcgctatcggaccaaagccgtgagctctgaggtggatgagagcctctttggagatatcaagtccccagcccagggccagagcgacagccccattgtgctgctccgagataagcatacccttcaaaaaactctcactgctttgggcttggatcgcaagccagagaccatccagctcatcacccgggacatggtccgagaactcattgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggatgcagtgatgacacgaaagaagatcatgaaacagaaggagatggtgtggaacaacaacaagaagctcagtgacctggaggaggtggccaaggaacgggcccagaacctcctgcagagagccaacaagctgcggatggagcaggaggaggagctcaaggacatgagcaagattatcctcaatgctaagtgccatgccatccgggatgcccaaatcctggagaagcagcagatccaaaaagaactggacacagaagagaagcggttggatcagatgatggaagtggagcggcagaaatccattcaaaggcaggaggaactggagaggaagaggagggaggaaagaattagaggaaggcggcaaattgtggaacagatggaaaagaaccaggaggagcgatcgctgcttgctgagcagcgggagcaggagaaggagcagatgctggaatatatggaacagctccaagaggaagatctaaaggacatggaacgaaggcagcaacaaaaactgaagatgcaagctgagattaagcgcatcaatgatgaaaaccagaaacagaaagcagaactgctggctcaggagaagctggcagaccagatggtgatggagtttaccaagaagaagatggctcgagaagcagagtttgaggctgagcaggagagaatccggagggagaaagagaaggagatcgcacgcttgagggccatgcaggagaaggcccaggattaccaggcagaacaggatgccttgcgggccaagcgcaaccaggaggttgcagacagagagtggcgcagaaaggaaaaggaaaatgcgcggaagaagatggaaacagaggctgagctgcgaaaaagtcggctcgaacaggtggctttcaaggagcacgctctggctgttcaggtgcaacgggaccgggatgagttcgagaggattcttcgggctcagagagaacagattgagaaggagcggctggaggaggagaaaaaggccacagggcgcttacagcatgccaatgagctccggcgccaggtgcgcgagaaccagcagaaggaagtgcagaaccggattgccacctttgaggagggccggcgcctcaaagaggaggcccagaaacgccgtgagcgcatcgatgagatcaagaggaaaaagcttgaagagctgagagccactggccttcccgagaagtactgcattgaagctgagcgcaaagctaacatcctgccagctacctctgtgaactgaggggagccttcgtggccctcaggatgccttcgggggacagattctgcccagtctctgggcatccataattgctgctaacctagacatttcatagttacagattaaatctacttgacttt

SEQ ID NO: 6356 - DNA, 2319 bp, Homo sapiens
ctcacatccggcatgcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggacctgggctatcccttggagcttggctatcagaacttcctctaccccagtgagcctgacctccgagacctgcttctcttcttggctgagcgtctgcccaccgatgcctctgaggatgcagaccagcctgcaggtgactcagctattctcctccgggccattgggagccaaattcgggaccagctggcactgccttgggtcccgccccaccttcgcactcccaagctgcagcacctccagggctcggccctccagaagcctttccatgccagcaggctggtcgtgccagaattgagttccagaggtgagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggagccccaggcccaggccactcaggtgtcagatgtgccagccacctcccggcggcctgaacaggtcacgtgggcagctcaggaacaggagctcgagtcccttcgggagcagctggaaggagtgaaccgcagcattgaggaggttgaggccgacatgaagaccctgggcgtcagctttgtgcaggcagagtctgagtgccggcacagcaagctcagtacagcagagcgtgagcaggccctgcgcctgaagagccgcgcggtggagctgctgcccgatgggactgccaaccttgccaagctgcagcttgtggtggagaatagtgcccagcgggtcatccacttggcgggtcagtgggagaagcaccgggtcccactcctcgctgagtaccgccacctccgaaagctgcaggattgcagagagctggaatcttctcgacggctggcagagatccaagaactgcaccagagtgtccgggcggctgctgaagaggcccgcaggaaggaggaggtctataagcagctgatgtcagagctggagactctgcccagagatgtgtcccggctggcctacacccagcgcatcctggagatcgtgggcaacatccggaagcagaaggaagagatcaccaagatcttgtctgatacgaaggagcttcagaaggaaatcaactccctatctgggaagctggaccggacgtttgcggtgactgatgagcttgtgttcaaggatgccaagaaggacgatgctgttcggaaggcctataagtatctagctgctctgcacgagaactgcagccagctcatccagaccatcgaggacacaggcaccatcatgcgggaggttcgagacctcgaggagcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgcagtctaa

SEQ ID NO: 6357 - DNA, 1921 bp, Homo sapiens
atccggcatgcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggacctgggctatcccttggagcttggctatcagaacttcctctaccccagtgagcctgacctccgagacctgcttctcttcttggctgagcgtctgcccaccgatgcctctgaggatgcagaccagcctgcaggtgactcagctattctcctccgggccattgggagccaaattcgggaccagctggcactgccttgggtcccgccccaccttcgcactcccaagctgcagcacctccagggctcggccctccagaagcctttccatgccagcaggctggtcgtgccagaattgagttccagaggtgagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggagccccaggcccaggccactcaggtgtcagatgtgccagccacctcccggcggcctgaacaggtcacgtgggcagctcaggaacaggagctcgagtcccttcgggagcagctggaaggagtgaaccgcagcattgaggaggttgaggccgacatgaagaccctgggcgtcagctttgtgcaggcagagtctgagtgccggcacagcaagctcagtacagcagagcgtgagcaggccctgcgcctgaagagccgcgcggtggagctgctgcccgatgggactgccaaccttgccaagctgcagcttgtggtggagaatagtgcccagcgggtcatccacttggcgggtcagtgggagaagcaccgggtcccactcctcgctgagtaccgccacctccgaaagctgcaggattgcagagagctggaatcttctcgacggctggcagagatccaagaactgcaccagagtgtccgggcggctgctgaagaggcccgcaggaaggaggaggtctataagcagctgatgtcagagctggagactctgcccagagatgtgtcccggctggcctacacccagcgcatcctggagatcgtgggcaacatccggaagcagaaggaagagatcaccaagatcttgtctgatacgaaggagcttcagaaggaaatcaactccctatctgggaagctggaccggacgtttgcggtgactgatgagcttgtgttcaaggatgccaagaaggacgatgctgttcggaaggcctataagtatctagctgctctgcactttattggggacggtactgtgggttgggggccttggatcccaaataaatgagtagttcctctgc

SEQ ID NO: 6358 - DNA, 1089 bp, Homo sapiens
aaagccaccaccattttgtaaggaactgtagcttctctctgaaactgccgggaaagggaaaatctttttaaaatagacatcacacaaccaacagggtcccctaggttcaggcggggaggtgaggtcgagtgagaggaactgcttagcatacgcggggatgctcctcccatctcaccccaccgcgctaaggagaaggtcactttctctttaaatgcaaatgaactccctccagcttagctttcacccggtggtgttcccgggaggagagggcggagggcggagggaacttgcaccgaagcatcactcgagaccccaaacctccaggcctgaggcccagccagcgcccaatggatgacaaaaagaagaaacggagtcccaagccctgcctggcccagccagcccaggccccaggcacactacggagggtccctgtgcctaccagccacagcggctccttggccctaggacttcctcatctgccatcccccaagcagcgggccaagttcaagagagtaggcaaagagaagtgccgcccagtcctggctggaggtggaagcggctctgcaggcacgcccctgcagcactccttcctgaccgaggtgactgatgtctatgagatggaggggggactcctgaacctgctcaatgatttccactctggccggctgcaggccttcgggaaggaatgctcctttgagcagctggagcacgttcgggagatgcaggagaagctagcccggctgcacttcagcctggatgtgtgtggggaggaggaggacgatgaagaggaagaggatggggtcactgaggggctgccagaggagcagaagaagacaatggctgaccgtaacctggaccagctgcttagcaatctggaagacctcagtaattctatccagaagctgcacctggccgagaacgccgagcctgaggagcagtccgctgcgtaggcgtcccacgcaggcccacactgcccctctcattctcttcaaactgtgactttttacagactcgggcgggtgttctgcggccccccaggtgctatgggggaggggggcgttgaatggaattaaaccagaaagaaagcaa

SEQ ID NO: 6359 - DNA, 2109 bp, Homo sapiens
tccccgccgcggctccgccagtttgaacttggcgggccagatgtgggcggcggggcgctgggggcctacttttccctcttcctacgccggtttctctgctgactgcagacccaggtctcggccctcctcggactcctgctcagtccctatgacgggcgcacgtgggcaggggctggaggtggtgcgctcgccgtcgccgccgctgccgctgagctgcagcaattccaccaggtcgctgttgtctccccttggccaccagagcttccagtttgacgaggacgacggtgacggggaggatgaggaagacgtggatgatgaggaagacgtggatgaagatgcccatgattcagaggccaaagtggcgagcctgagaggaatggagttacaggggtgcgccagcactcaggttgaatcagaaaataaccaagaagaacagaaacaggtgcgcttaccagaaagccgcctgacaccatgggaggtgtggtttattggcaaagaaaaagaagaacgtgaccggctgcaactgaaagctctagaggaattaaatcaacaactagaaaaaagaaaagaaatggaagaacgtgaaaaaagaaagataattgctgaagaaaagcacaaggaatgggttcagaaaaagaatgagcaagtaaggaggggaaaatggatacacacattgacatctcttttgcaaaatatttcttcctattatacttcattacctaggttttaaaaaatacttctcttagagtctttcttctttggcttgttttgtttttctatcctggtggacatttatcaagtctctatcttctgccctttgccctctacttttctcctttttccctcctgtggcttgcactaatatttgcctgcaggcagtcaccaagtctgtatttctaggcctgaccttttggatccttatggcaagtgcctccaagtctgcaaatctaaaacaacccattttgcccatttctccttcgtaaatccatcctcccatttctctgtttcattcagctgtcttctcggtcatcaaggcttaattagaattcttctgttgttcctaatcatctcctccttttctttacaattactactcccctgtttgtgatctctttccattatatctttcaacttgttgtttacttcttatactggattgtaagctacataagggcagggatttttgcctcttttgttcagttttccaggagctagatgaatacctgcgcatgatatatgtccaaaaatagtttaattgagtgaagatgttcattgaatggctgcattttttccttttaattttaatatattcttctatggatcacacacattcgaaattttaaaaatacttattctgtggtcaatttgtcttctgttgtgatttttacatatttagagtggtactgcttttattattataatccagttttacaaatgtggaaaaatgtttaaattgtaggacaatattttaaattttaattctaactttttatctttattgttgaatctaatgcctaatggtattaataagagtactaagtaaataatttcagtaaattgaagatgatataaccttcttcatccaagtattataagaaggaaattggttagatgtatgtgtgttataaccatatttgtttagaagtcaattactttgtttttttaaaaaagtttacttcatcccatgatataacatgaaagagatctttgtgaataaattcaaaaatcaaaataaatctctgtgactgttataaaactttgggtaatatctttttgaaatttgtaactataaaacaaaattattttacacatgcagaatagtttgctctttcctctaaaagtccttcttatcttctaactccattaagctaattttaccatgccaatcaaacctagttgttgtttgtctaggaatgtaagatacttctgggagacaatatattcactgttttaattagtggcagtagacctaatccaattatttgaagaaaaaaaaaattatttcttttggagggaagtggcttgccctgacataaatcactagttattgaaggcaaaattccgtaatgttgagaattatttaaaaataaaactgagacgttatattta

SEQ ID NO: 6360 - DNA, 2088 bp, Homo sapiens
gagacttttaatcatctatcccttgtgctttacgcagaccctacaatacactagaggcttcaaagaggtcaaaaattcacatgtgtagacaaattaggtcccttaagatgccaggcaaacgaagtgctaccaaaacacgcaatgactgtcctaaaagtgcgttctgggatacacctgtaaacttggatcaagttccctcccctctcctcaaaatatatcgacttgtgctgaaagaaatcacgaccgatgctcacaattctgacctcgtaattatatagggggtggttttggtttctgcgtctttccctgattcagtggcaggtaacatatttcatgtacaaaatgaactgcaacaccacggcaaacaagggacaggccctcaaagttgtcggtagggagccaggaccccgccagtggcgtggggagacaccgtactaaacaagcttgcaaacagcaggcaccttcctgccactgaggaggaagggctggctaagggaggccggggcggaggaagccaagctctgcaggccctgacaaagtcctcccggcctccacgcgtcgccatggcaacgcggggtctgtgctggccgggattggccggcctggcgcgcgcagggcccgctgggaaagcgcgtccccgccgcggctccgccagtttgaacttggcgggccagatgtgggcggcggggcgctgggggcctacttttccctcttcctacgccggtttctctgctgactgcagacccaggtctcggccctcctcggactcctgctcagtccctatgacgggcgcacgtgggcaggggctggaggtggtgcgctcgccgtcgccgccgctgccgctgagctgcagcaattccaccaggtcgctgttgtctccccttggccaccagagcttccagtttgacgaggacgacggtgacggggaggatgaggaagacgtggatgatgaggaagacgtggatgaagatgcccatgattcagaggccaaagtggcgagcctgagaggaatggagttacaggggtgcgccagcactcaggttgaatcagaaaataaccaagaagaacagaaacaggtgcgcttaccagaaagccgcctgacaccatgggaggtgtggtttattggcaaagaaaaagaagaacgtgaccggctgcaactgaaagctctagaggaattaaatcaacaactagaaaaaagaaaagaaatggaagaacgtgaaaaaagaaagataattgctgaagaaaagcacaaggaatgggttcagaaaaagaatgagcaaaaaagaaaagaaagagaacaaaaaattaataaagaaatggaggaaaaagcagcaaaggaactggagaaagaatacttgcaagaaaaagcaaaagaaaaatatcaagaatggttaaagaaaaaaaatgctgaagaatgtgagaggaagaagaaagaaaaggaaaaagaaaaacaacagcaagctgaaatacaggagaaaaaggaaatagcagaaaaaaagtttcaagaatggttggaaaatgcgaaacataaacctcgtccagctgcaaagagctatggttatgccaatggaaaacttacaggtttttacagtggaaattcctatccagaaccagccttttataatccaattccgtggaaaccaattcatatgccacctcccaaagaagctaaggatctatcaggaaggaagagtaaaagacctgtgataagtcagccacacaagtcatcatctctggtaattcataaagccaggagcaatctttgccttggaactctgtgcagaatacaaagatagcgtatgtggaaaataacatgcttttatctggagctatttaatttaaaaatcagaaattgttttttactgctcagtcaataactcaacacttaatgtgattattgacaaatagcaatttttgcatttgtatatggagtccttagagttgaggaagatattttctggattttggtttttataaactttttaaggttgatcttggcatgttgttttgcagaataagtggctgaatatgtaagaattgtgtttgtatttagcttgtattaaaagtacactgtaataccaataaaac

SEQ ID NO: 6361 - DNA, 4450 bp, Homo sapiens
tctttatacttttgtattgtttaattttttttaacagttgtcttgttttttcttctgcagtgaaaataatggtgacaagaagcccactgcctgattcacataagcaaggcatgctgcagggaagacagggttcttattaatatttcctttcatgtgcttacatatgagttacagttgctaatcctttcccacagtttagcacctagttaaaagaaagggcttcggaatcaggtaagtgtagattaaagttataacggcaaattgctgaacctttggaagcctcggtttttccacctggaaaatggatttttatcttacaggactgtcgtgaggattgatgagctaacattcctaaatcagggagtttgaagtctggcccagggtattttcctcctttcctgaaataatgtgtagttctgaccaagtgagaagaatcataagaatatgggattttgaaaaacatgaaaacatcctaagaaataccaggaaggagtcccacagtgaagcacaaatgaaactcaagatgactgcctaaaataagaaatcatggatcttaggagaaagggggcaaggaagtaaatcaaaggacaaagctgaagaccaagtggaccgaaaagaagatggaatacattttcccaaacactggtgttctctggagttggcttatcaacatcttgtgcaatcggaggatcgtgtggtttacttccagccagctgccccgtggtcctccagccagctccgggggccacagttttcacacgctccgggagcgatccgagagccgccttttcgtggaaagttacgctgccgcctggcaacccccgggaacgtcgggaggggcaagttgctgctcatccctcagtgctcaagtcatgagtagcgaattcctggctgagctgcactgggaggatgggttcgccatcccggtggcgaacgaggagaacaagctactggaagatcagttgtcaaagctgaaggatgaaagagcaagcttgcaagatgagttacgtgagtatgaagagcgaattaattctatgacttctcacttcaaaaatgttaagcaagagctctcaattacacagtctctttgcaaagcaagggagcgtgagactgaaagtgaagaacattttaaggccattgctcaaagagaattgggacgagtgaaagatgaaattcaacggctggaaaatgagatggcttcaatactggaaaagaaaagtgataaagaaaatggcatatttaaagccactcaaaaattggatggtttgaaatgtcaaatgaactgggaccagcaagcattggaggcctggttagaagaatcagctcataaagatagtgatgctctcactctccagaagtatgcacaacaagatgataataaaatcagggcactgactctgcaattagaaagactaactttggaatgtaatcagaaaagaaagatacttgacaacgaacttacagagactataagcgcacagttagaattggataaagcagcacaagattttcgtaagattcataatgaaagacaagaactcattaaacaatgggagaacacaatagaacagatgcagaagagggatggagacatagataactgtgctttggaattagcaaggataaagcaggaaacgagagaaaaagaaaatttggttaaagaaaagatcaagtttttggaaagtgagattgggaataacacagagtttgagaaaagaatttctgtggctgatcgtaaacttttaaaatgtagaacggcatatcaggaccatgaaactagtagaattcagctgaagggtgagctggattctttaaaagccactgtgaatagaacttccagtgatttagaagctctgaggaaaaatatttccaagataaagaaggacattcatgaagaaacagcaaggttacaaaaaactaaaaatcataatgagataatacaaacaaaattaaaggagataactgagaaaaccatgtctgtagaagagaaagctactaatttggaagatatgctaaaggaggaggaaaaagatgtgaaggaagtagatgttcaactgaacctcataaaaggtgtgctgtttaagaaagctcaggagttacagactgagacaatgaaagaaaaagctgttttatcagaaattgaaggaactcgttcctctctgaaacatctcaaccatcagttacaaaaactggattttgaaaccttgaagcagcaagaaattatgtacagccaggattttcacattcaacaagtggaacggagaatgtcacggttaaagggagaaattaattcagaagaaaaacaagcgcttgaagcaaaaattgttgaacttaggaagtctttggaagagaaaaaatctacatgtggccttttggaaacacagatcaagaagcttcataatgatctttattttatcaagaaggcacatagtaaaaacagtgatgaaaaacagtcccttatgaccaaaataaatgaactaaaccttttcatcgacagatcagagaaagaacttgataaagccaaaggttttaagcaggatttgatgatagaggacaatcttttaaaacttgaagttaagcgtactcgagaaatgcttcacagtaaggcagaagaagttctttccctagaaaaaagaaaacagcaattatacacagcaatggaagagcgaactgaagaaatcaaggttcataaaacaatgcttgcgtcacaaataagatatgttgatcaagaacgggaaaacataagcactgagtttcgcgagcggctaagtaaaattgagaagctgaagaatagatatgaaattctgactgttgttatgctgcctcctgaaggagaagaggagaaaacacaggcctattatgtaataaaggtgatgagtatgagctaaaaattcaactagaagaacaaaaaagagctgttgatgaaaaatacagatacaaacaaagacaaatcagagaacttcaagaagacatccagagcatggaaaatacattagatgttatagaacatttggcaaataatgttaaagaaaagttatcagagaagcaggcttattcatttcaactaagtaaagaaacggaggagcagaagccaaaattagaaagagtgaccaaacagtgtgcaaaactcacaaaggaaatccgtcttttgaaagacacaaaagatgaaacaatggaagaacaagacatcaaacttcgtgaaatgaaacagtttcacaaagttattgatgaaatgttagttgatatcatagaagaaaatactgagatccgtattatccttcaaacatactttcaacagagtgggttagaactacctacagctagcacaaaaggcagtcgtcagagctctagatctccttcacatacttcactatcagcaaggtcatctaggagtacaagtacatctacttctcagtcttcaattaaagtactggagcttaaattcccggcctcctcttcactagtaggcagcccttctaggccatctagtgctagtagtagctctagtaatgttaagagcaaaaagagcagcaaataaacattttaatctcttctgaaaaagttgtaaacacaaaaacaaaaatatactttaaaatacaaaacgacccaacacattttatctagtggaaagtgtaaaaacttagtggtaagtgtaaaaactgatagttttaaaaaaaaaggaacgttctcattttctctactgttttcttcatactgaagaaattaatagcagattcttgacaaggctacatgttatacaagcataggaaaaatgctgtatttcactgtaattctgatgttcgtagtgttagaaaatagtttgcttcattatttcacgaaactacactcacttctaatgtaacaatctttcaagaagaaatttctaaagatttactgtactattatgagcgtattgcaatgtgaaaatctcatttaccctacaagacaccaaaattaggttttctttattcaaagtaactatttctcagacttttggggagaaaaattgttaaaggcagtttcttcttttgctataatttttaaccaaaaaatagcatcaacccctacccaccccacccccccaaaaaaaaaccggtaagagaaacactgtatatcaattttaaaatgcagcataaatttagaaaaatcacttctgaccttgaaataaatcacttctgaccttgaaataaacgcattaaagatttgctttcagatacagccaaccaagtataaacaattttgaaattttcttgatttaataaacgatttaatgaaagctaggtatgacttgatttgcaatagaaatttcatttacagttggaggtagactgccaaatgtagtagtttttccagttaacacttcattataacatgtgcccaacactttgtactcttggaatagagtgtggaatattataaaactggattttaaataaatgtattagaattc

SEQ ID NO: 6362 - DNA, 3279 bp, Homo sapiens
agggctcccccggcaattgccgcggcactgtgcaggtgcctgggcttgacgcgggtgctgctcacccgctgtacaagaaggcggatctttgctctgtatcttctctatccgtttgcagtcatgagtagcgaattcctggctgagctgcactgggaggatgggttcgccatcccggtggcgaacgaggagaacaagctactggaagatcagttgtcaaagctgaaggatgaaagagcaagcttgcaagatgagttacgtgagtatgaagagcgaattaattctatgacttctcacttcaaaaatgttaagcaagagctctcaattacacagtctctttgcaaagcaagggagcgtgagactgaaagtgaagaacattttaaggccattgctcaaagagaattgggacgagtgaaagatgaaattcaacggctggaaaatgagatggcttcaatactggaaaagaaaagtgataaagaaaatggcatatttaaagccactcaaaaattggatggtttgaaatgtcaaatgaactgggaccagcaagcattggaggcctggttagaagaatcagctcataaagatagtgatgctctcactctccagaagtatgcacaacaagatgataataaaatcagggcactgactctgcaattagaaagactaactttggaatgtaatcagaaaagaaagatacttgacaacgaacttacagagactataagcgcacagttagaattggataaagcagcacaagattttcgtaagattcataatgaaagacaagaactcattaaacaatgggagaacacaatagaacagatgcagaagagggatggagacatagataactgtgctttggaattagcaaggataaagcaggaaacgagagaaaaagaaaatttggttaaagaaaagatcaagtttttggaaagtgagattgggaataacacagagtttgagaaaagaatttctgtggctgatcgtaaacttttaaaatgtagaacggcatatcaggaccatgaaactagtagaattcagctgaagggtgagctggattctttaaaagccactgtgaatagaacttccagtgatttagaagctctgaggaaaaatatttccaagataaagaaggacattcatgaagaaacagcaaggttacaaaaaactaaaaatcataatgagataatacaaacaaaattaaaggagataactgagaaaaccatgtctgtagaagagaaagctactaatttggaagatatgctaaaggaggaggaaaaagatgtgaaggaagtagatgttcaactgaacctcataaaaggtgtgctgtttaagaaagctcaggagttacagactgagacaatgaaagaaaaagctgttttatcagaaattgaaggaactcgttcctctctgaaacatctcaaccatcagttacaaaaactggattttgaaaccttgaagcagcaagaaattatgtacagccaggattttcacattcaacaagtggaacggagaatgtcacggttaaagggagaaattaattcagaagaaaaacaagcgcttgaagcaaaaattgttgaacttaggaagtctttggaagagaaaaaatctacatgtggccttttggaaacacagatcaagaagcttcataatgatctttattttatcaagaaggcacatagtaaaaacagtgatgaaaaacagtcccttatgaccaaaataaatgaactaaaccttttcatcgacagatcagagaaagaacttgataaagccaaaggttttaagcaggatttgatgatagaggacaatcttttaaaacttgaagttaagcgtactcgagaaatgcttcacagtaaggcagaagaagttctttccctagaaaaaagaaaacagcaattatacacagcaatggaagagcgaactgaagaaatcaaggttcataaaacaatgcttgcgtcacaaataagatatgttgatcaagaacgggaaaacataagcactgagtttcgcgagcggctaagtaaaattgagaagctgaagaatagatatgaaattctgactgttgttatgctgcctcctgaaggagaagaggagaaaacacaggcctattatgtaataaaggctgctcaagaaaaagaagaacttcaaagggaaggtgactgtttggatgccaagatcaacaaagctgaaaaagaaatctacgctctagaaaatacccttcaagtgctgaacagctgtaacaacaattataagcaatcttttaaaaaagtgactccatctagtgatgagtatgagctaaaaattcaactagaagaacaaaaaagagctgttgatgaaaaatacagatacaaacaaagacaaatcagagaacttcaagaagacatccagagcatggaaaatacattagatgttatagaacatttggcaaataatgttaaagaaaagttatcagagaagcaggcttattcatttcaactaagtaaagaaacggaggagcagaagccaaaattagaaagagtgaccaaacagtgtgcaaaactcacaaaggaaatccgtcttttgaaagacacaaaagatgaaacaatggaagaacaagacatcaaacttcgtgaaatgaaacagtttcacaaagttattgatgaaatgttagttgatatcatagaagaaaatactgagatccgtattatccttcaaacatactttcaacagagtgggttagaactacctacagctagcacaaaaggcagtcgtcagagctctagatctccttcacatacttcactatcagcaaggtcatctaggagtacaagtacatctacttctcagtcttcaattaaagtactggagcttaaattcccggcctcctcttcactagtaggcagcccttctaggccatctagtgctagtagtagctctagtaatgttaagagcaaaaagagcagcaaataaacattttaatctcttctgaaaaagttgtaaacacaaaaacaaaaatatactttaaaatacaaaacgacccaacacattttatctagtggaaagtgtaaaaacttagtggtaagtgtaaaaactgatagttttaaaaaaaaaggaacgttctcattttctctactgttttcttcatactgaagaaattaatagcagattcttgacaaggctacatgttatacaagcataggaaaaatgctgtatttcactgtaattctgatgttcgtagtgttagaaaatagtttgcttcattatttcacgaaactacactcacttctaatgtaacaatctttc

SEQ ID NO: 6363 - DNA, 1767 bp, Homo sapiens
gttgacagcgtcgcctagcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtggagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcagaacatcgaccaggacatgcgtgacgacatccgcgtgatgacacaagtggtaaagaaggccgagacggagaggatccgggcagaaatcgagaagaaaaagcaggacctgtatgtggaccagctcaccactcgagcccagcaactggaagaagacattgccctgtttgaggctcagtacttggcccaagctgaggacacccggattttaaggaaagcagtgagtgaggcctgcaccgagatcgacgccatcagcgtggagaagaggcgcatcatgcagcaatgggccagcagcctggtgggcatgaagcaccgcgacgaggcgcacagggcggtgctggaggcgctcagcgtgtccctagagcgcttcccaagtcaaaatataaacaccgctcgttcccgcctttctaccacatggcattccgctgggatacttctacggggaagcttcctgcccggggcatcgagggcgttcgcgtccgtctgttatggcggtgctgctgtagataaccggatccgcgaatgctaa

SEQ ID NO: 6364 - DNA, 1464 bp, Homo sapiens
gttgacagcgtcgcctagcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtggagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcagaacatcgaccaggacatgcgtgacgacatccgcgtgatgacacaagtggtaaagaaggccgagacggagaggatccgggcagaaatcgagaagaaaaagcagggcgttggagacacaggtgctgccttcattcctaaaaccacccagggtgaccaggtctcgggacgcggaaagaaaaagccgggcactgtggtggcacgtgtctcacccgctgagctttaa

SEQ ID NO: 6365 - DNA, 3120 bp, Homo sapiens
gttgacagcgtcgcctagcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtggagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcagaacatcgaccaggacatgcgtgacgacatccgcgtgatgacacaagtggtaaagaaggccgagacggagaggatccgggcagaaatcgagaagaaaaagcaggacctgtatgtggaccagctcaccactcgagcccagcaactggaagaagacattgccctgtttgaggctcagtacttggcccaagctgaggacacccggattttaaggaaagcagtgagtgaggcctgcaccgagatcgacgccatcagcgtggagaagaggcgcatcatgcagcaatgggccagcagcctggtgggcatgaagcaccgcgacgaggcgcacagggcggtgctggaggcgctcagaggatgccagcatcaagccaaatccaccgacggcgagattgaggcctataagaaatccatcatgaaggaggaagaaaagaacgagaagctggcgagcatcctgaaccggacagagacggaagccacactgctgcagaagctcaccacccagtgcctgaccaagcaggtggccctgcagagccagttcaatacctacaggctcaccctgcaggacacagaggatgccctcagccaggaccagctggaacaaatgatactcacggaggagttgcaggccatccgccaagccatccagggcgagctggagctcaggaggaagacggatgctgccatccgggagaagctgcaggagcacatgacctccaacaagaccaccaaatacttcaaccagctcatcctgaggctgcagaaggagaagaccaacatgatgacacatctttccaaaatcaacggtgacattgcccagaccaccctggacatcacacacaccagcagcaggctggacgcacaccagaagaccctggtggagctggaccaggacgtgaagaaagtcaacgagctcatcaccaacagccagagcgagatctcccggcgcacgatcctgatcgagaggaagcaagggctcatcaacttcctcaacaagcagctggagcggatggtctccgagctggggggggaagaagtggggcccctggagcttgaaatcaaaaggctgagcaagctgatcgacgagcacgatggcaaggcggtccaggcccaggtgacctggctgcgcctgcagcaggagatggtcaaggtgacacaggagcaggaggagcagctggcctccctggacgcatccaagaaggagctccacatcatggagcagaagaaactacgagtagaaagcaagattgagcaggagaagaaggagcagaaggagatcgagcaccacatgaaggacctggacaacgacctgaagaagctcaacatgttgatgaataaaaaccggtgcagctcggaggagctggagcagaacaaccgggtgacagagaatgagttcgtgcgctcgctgaaggcctctgagagggagaccatcaagatgcaggacaagctgaaccagctcagcgaggagaaggcgaccctcctgaatcaactggtggaagcagaacaccagattatgctttgggagaaaaaaatccaactggcaaaagagatgcgttcctcagtggattccgagatcggccagacggagatccgggccatgaagggcgagatccacaggatgaagaaatattgcagaacaacacaggacgcacacaggcacgtgcacgaacaacacgggacgcacgcaggcacgtgcacgaagaacacgggacgcgcgcaggcacgtgcacgaacaacacgggacgcgcgcgggcacgtgcacgaacaacacgggacgcgcgcaggcacgtgcacgaacaacacgggacgcgcgcaggcacgtgcacgaacaagggacgcgcgcaggcacgtgcacgaacacaggacacacacagcacgtgcatga

SEQ ID NO: 6366 - DNA, 4287 bp, Homo sapiens
gcgtcgcctagcaacgggaaatggcggaaccgggcggcgcggcgggccggtcccatccggaagatggatcggcttctgagggagagaaggaagggaataatgaaagccacatggtgtcaccaccagagaaggatgatggccagaaaggtgaagaagctgtcggtagcacagagcatcctgaggaagtcacaacccaagcggaagctgcaattgaagagggggaggtggagacagaaggggaagcagcagtggaaggggaagaggaggctgtgtcctatggagatgctgaaagcgaagaggaatattactatacagaaacttcatccccggaagggcaaatcagtgctgcagatacgacttacccgtatttcagtcctcctcaggaactgcctggagaggaggcatacgatagtgttagcggggaggctggtctccaaggcttccagcaagaggccaccggtccaccagaatccagagaaaggagggtcacctccccagagccatcccacggagtcttaggcccgtcggagcaaatgggccaggtcacctctgggccagcagtgggcagattgacaggatccacagaggagccccaggggcaggtgctcccaatgggcgtccagcaccgcttccggctgagccacgggagcgacatcgagtcctcagacctggaggagttcgtctcgcaggagccagtgatccccccaggggtgcccgatgcccaccccagggaaggagacctgccagtgttccaggaccagatccagcagcccagcaccgaggagggggccatggcagagagagtggagtccgaggggagtgacgaggaagcagaagacgaagggtcccagctggtggttttggacccagaccaccccctgatggtaagattccaggctgccctgaagaactacctgaaccgacagatcgaaaagttgaagctggacctccaagagctggttgtggctaccaagcagagccgagcccagcggcaggagctgggggtgaatctctatgaggtgcagcagcacctggtacacctgcagaagctgctggagaagagtcacgaccgccacgcaatggcctcgagcgagcgcaggcagaaggaggaggagctgcaggccgcccgcgctctctacaccaagacctgcgcagccgccaacgaggagcgcaaaaagttggcggctctgcagactgagatggagaacttggccctgcatctcttctacatgcagaacatcgaccaggacatgcgtgacgacatccgcgtgatgacacaagtggtaaagaaggccgagacggagaggatccgggcagaaatcgagaagaaaaagcaggacctgtatgtggaccagctcaccactcgagcccagcaactggaagaagacattgccctgtttgaggctcagtacttggcccaagctgaggacacccggattttaaggaaagcagtgagtgaggcctgcaccgagatcgacgccatcagcgtggagaagaggcgcatcatgcagcaatgggccagcagcctggtgggcatgaagcaccgcgacgaggcgcacagggcggtgctggaggcgctcagaggatgccagcatcaagccaaatccaccgacggcgagattgaggcctataagaaatccatcatgaaggaggaagaaaagaacgagaagctggcgagcatcctgaaccggacagagacggaagccacactgctgcagaagctcaccacccagtgcctgaccaagcaggtggccctgcagagccagttcaatacctacaggctcaccctgcaggacacagaggatgccctcagccaggaccagctggaacaaatgatactcacggaggagttgcaggccatccgccaagccatccagggcgagctggagctcaggaggaagacggatgctgccatccgggagaagctgcaggagcacatgacctccaacaagaccaccaaatacttcaaccagctcatcctgaggctgcagaaggagaagaccaacatgatgacacatctttccaaaatcaacggtgacattgcccagaccaccctggacatcacacacaccagcagcaggctggacgcacaccagaagaccctggtggagctggaccaggacgtgaagaaagtcaacgagctcatcaccaacagccagagcgagatctcccggcgcacgatcctgatcgagaggaagcaagggctcatcaacttcctcaacaagcagctggagcggatggtctccgagctggggggggaagaagtggggcccctggagcttgaaatcaaaaggctgagcaagctgatcgacgagcacgatggcaaggcggtccaggcccaggtgacctggctgcgcctgcagcaggagatggtcaaggtgacacaggagcaggaggagcagctggcctccctggacgcatccaagaaggagctccacatcatggagcagaagaaactacgagtagaaagcaagattgagcaggagaagaaggagcagaaggagatcgagcaccacatgaaggacctggacaacgacctgaagaagctcaacatgttgatgaataaaaaccggtgcagctcggaggagctggagcagaacaaccgggtgacagagaatgagttcgtgcgctcgctgaaggcctctgagagggagaccatcaagatgcaggacaagctgaaccagctcagcgaggagaaggcgaccctcctgaatcaactggtggaagcagaacaccagattatgctttgggagaaaaaaatccaactggcaaaagagatgcgttcctcagtggattccgagatcggccagacggagatccgggccatgaagggcgagatccacaggatgaaggtcaggctcgggcagctgctgaagcagcaggagaagatgatccgtgccatggagttggcggttgcccgcagagagaccgtcaccacccaggccgaggggcagcgcaagatggacaggaaggcgctcacccgcaccgacttccaccacaagcagcttgagctgcgccggaaaatcagggacgttcgcaaggccaccgatgagtgcaccaaaaccgtcctggaactggaagaaacacaaagaaatgtgagcagctccctcctagagaagcaggaaaagctgtcggtgattcaggcagacttcgacacactcgaggccgacctcacccggcttggggccctcaaacgacagaacctttcagagatcgtggccctgcagacacgccttaagcacctgcaggctgtgaaggaggggcgctacgtgttcctgttccgctccaagcagtccctagtgctggagcgccagcgcctggacaagcgactggctctcatcgccaccatcctggaccgcgtgcgggacgagtacccccagttccaggaggccctgcacaaggtcagccagatgatcgccaacaagctcgagtcaccagggccctcctagggagcagcctggactccgccttgcaaggcctccaggaagagatccggaattgtgtttgtcatgagggacttggaatcttttgtgttcctaaaaaccacatgtaccctcagaagggcatcgtttaagagaaataagccagccccacccataggaatctttttagccactcagcaatttaataaaccaggtaaaatcctagcgtttcccatggcatcccatcgcaaagacagagcctgtgactgcagacccacacacccacactcccacactgggcttactcgtccaggtaacactttggtttgcagcactcccaaatctgcacgtgcctctcacaacacaacgctgccacaggtccacaagctggtgggctgagcagaggtgggaaagttaaggcagctccagccagcctggcccgggaggctggtccccccagcacttccctctactaggtgcatctgaaaacccacaaaccaccttctttaccagttttcccatccccaccccttagaactctcaggtcccttttcctgcccccatgtccccatttgagttaaattcagatccacagcttgcaggagaaagtcagtggccccagacacacgtaacagggtgagcactgaaataagagcacgctggggcgtccacaccaagggactacgccccagtctgcccacctatcttttctccatcattaacccagcgctctttctccctggacttccaagtaccaatgaccttggggcttctttgcagtttaaagggaaaatgctctacaaaataatttcactttcaaacatttcagcagaagaataaaatcttttttctgaatatctagtaa

SEQ ID NO: 6367 - DNA, 8429 bp, Homo sapiens
cgctcacgggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgttttttgagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccatttaaataaggaaggggagacaaaatggaaggtcctggccttaagtcaaattccagatagtgctttcaatatccaaagcttaggccttgtttacttatagtaatgctatatttttctttatctgccctgtgatttcgcttcgtgtccttcaaagtttttttattgtaattttaaaggaaaaaaacaatgtatttttatttgataactaggcaaaatcatttgccattttttatttcataaatatttatttttctatctcatacaatgatcagttttactttaaaaattctgcatttctcttgcctctcatgtacttcatccagttatttattattgtaaaatgttaactggagatactgcattcaaaaaaaagtcggaccacttaacacttaccaggaatgttagtgtttcagctgttttagtaagtgaccaagtaagctatcaccttgtgatagctaattcaacatctttattgaaaatttgttactttttttaaaggtttttaaaagattacaattttaaaatattttatgtttattttatttttgtgtaaagcaaacacttttaaaataatatcagagtaattattaccctatgaataaggagatagaaatgaaattcagccagttaaatcctcatactctttctcattcaaataatataataatgtttgagactatagaagcaactcaactgtattttaatgaactgccagacacttttcactgtgttctctgctttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccagcagcagcataccaataaattacaaaagcagaaaatgaaaattaaccctaggtgttctgatgatagagaaatagctaaattagaaaagaaagatatggatagatgcttttaggaggaaaacctttttagaatggcaatgaccacttggatctaggtcaacatattccaaaatgtgtgaccttgggctttgtgtttactgaactcactctagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaattttctttaatagtttctgtcaaaacttgtctaaaatttgtgttgtgccaaattggaaatacccactataatatggtgcattcagtttactccacaagtggttaacattttaagtcctagattttttatgtcttgcctttgtataagcatcgctttggggaataccaagatgattcattattcagtgattattttcttgaaagataactatgatgattggctgtaaaatcttcaccctaataaaggagtgagatctctgtgtaaacagctttctgaaggactgataatagaatagaacttgcagccaaaggctttttcccttttgagaagacggtatttgtgtaaggagtgctaaggtagacttcattgtacatagagtgccatattctgttgaaacgatcataacaaaatcaaaacctcatgcttcagcaaaaaggaaaaaagatttttaaattactttgtctattacttactgctcatagagaagtgactatataaaatggtccaattttctcatttctggtggtgcctgtgagtcttaaagccatatctgcttatcttactgttgatagaatactttttttctttttagcccatgataagtaatatgggcaggtagaagcaaactggagactgtcctgttaatgctgcatggggcacaatgtctttcaaattattggtggaagaatctcttttatccatggcgagaggtaagaatattaaagagtcaggatattgttgctcctggtatttaacaactgtcattagaaatgctgaaatttaattgtagagaagtcaagaaagaaagagtaaactgagaaaatcttactactacagagtcacttttacaatgagacctgcactttatgccagcactgtttgtgaggagcagtactgccttaaattagtttgactctgactgatgtcagtgtacgttacttcctttatgtgactgacagtcagctttccattgagatataacattcacagatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaatccttcataccaggtaccacttcttgagtaactgagagttgactgtcttctatggtgactacatagaagatatttccaaaggttctgttatgcagtgaagacattcagattatttgtaagaatttcaccaacacccttgtgtattgaaatgcttaaccattaacagggaaaaaaaaggagaaaaccgaacaaaacagagacatttacttgaaatgggaggtttgctaatgtgaagagtgtttctgttttattacttataagagaaaagcaggaaaacttttgctttgataagaaagacaccagagtggtgattctgtttgatgccacaggctaacacaatcgtgtaatcatgttgagttgtagaaatatatggccctaaaaaccattctctttcccttatatatataaatatgtgaacactgcctagtaacattttaatagatttaagatgcatttgtacattctcagcaaactagaagaaaatgttttttctctttttgagttaacttcatagcatagagaaccagcactgtgcaggtttcagcatttcagataagggcataattaattgtgtaacttaatgccctgttattcattgctgaggttcatataaagaatagaaaaattgaaagatgggtttgggcgacattttcttcccaaaagatcaagtaaggagtaagaacaagtaagggaagacagctaagagaacatactatgacatatcatagaattgggatacatttttgttgcactggatttcaggctatactgctaaaataatttctacctgttaaattttgtgagagggtttttgacatcagaatttttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaagtcagtggtctctgtctcatgtttttgttttgtttctttacagcattcaaggacagggaaacttacgagagtcttattataattattattatttacaaaatgaccctaataggtctgtttagtaacagtgaaattttttcttactccatttccatacactttctgtaaatatgtataacatgataatgatgcctggtgtattgaaatcctcaataaatactgccaagtgtggatcagttgga

SEQ ID NO: 6368 - DNA, 2454 bp, Homo sapiens
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaagtatgccgagattttgctgtcctggaggaccacaccctggctcacagcctgcaggaacaagagattgagcatcatttggcatcgaacgttcagcggaaccgtttggtccagcatgatctccaggtggctaagcagctccaagaggaagatctgaaagcgcaggcccagctccagaagcgctacaaagaccttgaacaacaagactgtgaaattgctcaggaaattcaggagaagctggctattgaggcagagagacgacgcattcaggagaagaaggatgaggacatagctcgccttttgcaagaaaaggagttacaggaagagaaaaagagaaagaaacactttccagagttccctgcaacccgtgcttatgcagatagttactattatgaagatggagaccaaccagggtcaaggagggccagggaattgggttctggattctcaagaccttgtagactccaaagagatggaaagactgtgaagcacaagaaagagaaaccagaacatccactggagaacttggaagagccagaacaacattgttcatcgaagagatccctgtcatcctctagctcgggcaaagggagggacaatccccatattaacaatgagcagcatgaaaggaaacggtccactcaggagaggcctcggagacctctgcttcccacgatcagtggtgaagtgtttctgagcactgaatgtgatgactgggagactaagattaaccatcagactcgaaattgggaaaaacagtctcgacaccaagatcgactttcacccaagtcctcacaaaaagcagggcttcactgcaaggaagttgtatatgggagggaccatgggcaaggtgagcacagaaaaaggagacacaggcccaggactcctccattctcagagagtgaggagcagctccacctccatgacgcaggaatgaagccaagagtgatgaaagaagctgtatctactccatcacgaatggcccacagggatcaggaatggtatgatgctgaaattgccagaaaactgcaagaagaagaacttttggctacccaggtggacatgagagccgctcaagtagctcaagatgaagaaatcgctcgacttctaatggctgaagaaaagaaagcttacaaaaaagccaaggagcgggagaaatcatctttggacaaaagaaagcaagaccccgagtggaagccaaaaacagctaaagcagcaaattccaagtcaaaagagagtgatgaacctcaccattctaagaatgaaaggccagcacggccaccaccacctatcatgacagatggtgaagatgcggattacactcattttacaaaccagcagagttccacacggcatttctcaaaatcagagtcctctcataaaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttg

SEQ ID NO: 6369 - DNA, 5811 bp, Homo sapiens
agtgcaatactgcccaagcccgggcggggtctctgttctctggcagaggaggtcccttggcagcgggaagcgccctctctttctctcgccgccgctccgagtctgcgccctggtgccaggcgctcagctcggcgctcccctgtgctcgcccggcgcccactcattcgcagcccggccttcgtcgccgccgcctccctgctgctcctcctcctttccccagcccgccgcggccatggcggacagcgccagcgagagcgacacggacggggcggggggcaacagcagcagctcggccgccatgcagtcgtcctgctcgtcgacctcgggcggcggcggtggcggcgggggaggcggcggcggtgggaagtcggggggcattgtcatctcgccgttccgcctggaggagctcaccaaccgcctggcctcgctgcagcaagagaacaaggtgctgaagatagagctggagacctacaaactgaagtgcaaggcactgcaggaggagaaccgcgacctgcgcaaagccagcgtgaccatccaagccagggctgagcaggaagaagaattcattagtaacactttattcaagaaaattcaggctttgcagaaggagaaagaaacccttgctgtaaattatgagaaagaagaagaattcctcactaatgagctctccagaaaattgatgcagttgcagcatgagaaagccgaactagaacagcatcttgaacaagagcaggaatttcaggtcaacaaactgatgaagaaaattaaaaaactggagaatgacaccatttctaagcaacttacattagaacagttgagacgggagaagattgaccttgaaaatacattggaacaagaacaagaagcactagttaatcgcctctggaaaaggatggataagcttgaagctgaaaagcgaatcctgcaggaaaaattagaccagcccgtctctgctccaccatcgcctagagatatctccatggagattgattctccagaaaatatgatgcgtcacatcaggtttttaaagaatgaagtggaacggctgaagaagcaactgagagctgctcagttacagcattcagagaaaatggcacagtatctggaggaggaacgtcacatgagagaagagaacttgaggctccagaggaagctgcagagggagatggagagaagagaagccctctgtcgacagctctccgagagtgagtccagcttagaaatggacgacgaaaggtattttaatgagatgtctgcacaaggattaagacctcgcactgtgtccagcccgatcccttacacaccttctccgagttcaagcaggcctatatcacctggtctatcatatgcaagtcacacggttggtttcacgccaccaacttcactgactagagctggaatgtcttattacaattccccgggtcttcacgtgcagcacatgggaacatcccatggtatcacaaggccttcaccacggagaagcaacagtcctgacaaattcaaacggcccacgccgcctccatctcccaacacacagaccccagtccagccacctccgcctccacctccgccacccatgcagcccacggtcccctcagcagccacctcgcagcctactccttcgcaacattcggcgcacccctcctcccagccttaatgcatgagcttagtctgaatttcaagttgggactcatccaatggagccgtctactcaacgccaaaggcttccttctctggcatatttggatatgacttatttgcactgaggttatctaggcttcactatccattgtgttgtaaatgtttgtcagaaatgcagccagtgttgtgggtctacaacactaaccagacgactttttccatcagtgttttacttgaatcttcatgtacgtccattccctggctggaaccttcgctgtttggtatttggtatttcagcagcagtgtgcaatttttgcttggcccagagcttcattctcctggcttttaggtttgtaaaagaaaaagggatatcttttttatatttttttccatgaatctgcagaaaattactgagctgttgttaccctcctctcattataatagtgtttaccaaacataccaataattcagcactacaattcagacctttgaaaatctggctttcagtgtagaacagaaagttagatgaatcagtgcccaagacatattttctgtttaacagaactttctacagatacattttttacaggttattttcattgtgttattgacatccatgtctctcgtaaaacagatggcccaaagtaatgaatcatgtggctgtaccttctccacataaatgggatggataattatcgtatattaagatgtgattctcttttttatccttaatgttaatctacttaacctggccccctctaacatgagtcgataaatgttgtcctactcaccggtggtttcaatggctaattagaatgtgttatttgatttctgctgcagaaggcagtgtgattgtaacaaaaacaatgcggcttccccctttcgtacttcatttgtgttctcttaaaatagagtttgaacaaatattttaaaggtgcaaaataccattagaaaatactatttgaaatggacattatcgcattatcttggcataatggccagaaaatattgtattgcttggcagaaaagaaaataaggtctaaaggaaagtagcacattagcattgatggctgttcatttcacccagtataagcaagtgcagtgtacaaagaagtatattctgaatacattatttccattcatttagcacaaataaatcatttggtttcactttgcagtggaacactgagtcactcttttcttaacacgtgcaacatcttaatttttgtttttcagcagttgctgttttgtactttggtagtaaagtgatttttaccacctgtgtttgcatatttatatatgctgtggatgaaaataacttactagagaatgtatattttatgacaagaatgtgtatctgttggatataatcagagaactgaaaagtaatttatcagtaatttttaagagtccatgttttgtgacaaccatctctaatagccaactctttattaaacacactcctaaaaataaggaaccatgacattgtagatatttaatattgtacagtatagaaacctccatttttgccttcgaatgcatatttaagagttaacagaatgaaaaaaaaaagtcttgttggataatagtgtttgactagcgttttaagaacttgagagtaaaagcaacaataagattttttcacctcttcctgcttccacccccaaactgagaacatcactcaattgtttggaagaaactgtaggtctatataaattttatttataatgtatgtgtaatatacataatcataatacagttctcagatgcagggaagaagtttggcatttaatcattgaggctttaggtttttgatgtgatcagactgggccatgtcaaacccggaattttcaccaacagttcactcaccctcctggtacattgccattccaaggaattctgagagtaggcaaacaaattttgccttcatggtacagttctcagtttttcttataggagaaatatggtatatgtttataagaatcttttatgagattatagatttcaatgctgtggatagtgtcttgcacccaaacaagaaagtccataatggaatgatcttccctcagcttcctatcgatttagttacctcttgaaagcacaaaaattaaaacattgccatatgttgaatttttaaaaagcacttggagtgagcgaacatttcctgataaatgccttttagagataggttcttgatattcagacatctgcagaaatgttctggttcccaaagtcatttcacttcgaaataaaacacagctccttcaaacagcactttttccacataaatctagttgcctctccctgtggacattcagaactgatagaacaaacactactcttttgaatttgatggttcgtgtcctttaaagtgtttgaggacctatgcagagcctgtaacacttgggtagtacctgctaggacaatttcttggcaattgtcttactactagggatcagtaagatttagattctgagcccataatggcaacagccccctcacctatgggaagctgacttccctcagtcgggcacttctcatgggggctgaacatggttcctgccattctgttacccactctcccaggtgagccctggattggctcccagaaggcctttgtaaaatcagtagccgtcctgcaggcaggtgggagcaacaggggcttcagtagcttcattttcctgtcttgcagacagagacccttggctaccactgtgctgctaataggataagtactctgttgccagattaccatgccttttatacaaaaccaaattaacttacctaatacctgacacctctttgggctctgaactgctttctctcatcaagcatgctagcactctagacagaattctagaaatttggcagatagtggaagcctttaattgaacttactccttcgttgactgaaaggagttttaaattctgagctcctgagatactgactagcaaccatggaatgaatgtgtgaccagaaagtggctttgacaccaagtgctactgtccctttgtaattggcttctaacagaattcaaccagaaataattgataatgtgaatttttgttaattgttcacttgtaggaaaatagaacatgtatcaccctttgttaggtagacatgaacttttcctgcacaaagccttgcttttagagaatgcccaataaggcaagaaaaagcatagtaacttgtgctttgagagctcaatatttgtatcttatcagtacagaagaaatatttctgtgtaacttgatcttctgtctagtacttgtcttataggtaaccaacactgaaaactttgtagtgatgactaccaaagaaatacatagtaaaacaaccttttatttccaaattgttaaagagccagccattgatgctgctacatgagttccatgctcaagagccattgtaagagattaaggggtttctaggtttttggtgattttttgtttgtttttttctttgttttttagggtttttttttcttctttaattttttgattaaaacatacacacagctgttagcataaagtcgtggggggcattttctggaatgctcagcagttctgattaactgccaagcccaggttgcctctcatgaggcaactgaaaaaatcctgtgtcttgatagcatgggtgctgtgtgtgtgcatgtgtgtgtctgcattcatgccttaactcgggttactgcacaactttagttcttgacttagtctgcaccgtcatctagattgtattgtacatctcggtctgaacttcatcctggcaaaaacaaagttgcaggcacaacagtttaagaatgcattcctccagaagagtatctggtcaggttgacccctgagccttctttggacttgatttggaacttagcctggaaagcgaaagtggactgtccaacagaaagatgtcaacaaggaaaagaggagagccaagcgctagcatgccttttgcctctgcatatctgtgcacactgtatgttgttcatgatagcttgtctacaacttgactaggttggagttctggtaatagtggcaatcttgacattcttggtcagagtttagagagatgtaagactttcaattaatgtcttatttactcctttatgttgattagtctttgatacatgtgctgaatcagaaacctaaataaagataattttttaaaatgta

SEQ ID NO: 6370 - DNA, 3546 bp, Homo sapiens
gccggttctttcaggccttccagcgccggagcctcgggcgtgggcaaaaagcgtccatacgcagcctgagccacttgggagcccccagtttccgaggcagaagaacagtgcccaccagcgcagcggggctgcggcccggaaaccctggcggggagccccgagccccggcgggcgcacgccgcgtgggcaccaggcaggcggttggagtacggggcgggggtcggccgagggcgcggggccccggggctccgggctcgcccccgccgctcggggcaggcgcgccgatggcgtttctgaggtgacgccgcccacaccgggcttctccgggggcggaggaaacacctatgaaccctccggcagccttccttgccgggcgccagaacatcgggtcagaagttgagatttccactatcgagaaacaacggaaggagctgcagttgctcattggagaattaaaagatcgagataaagagctcaatgacatggttgcagtgcaccagcaacagcttctttcatgggaagaggatcggcagaaagtgttgacactggaagaacgttgcagcaaattagaaggtgaactacataaaagaactgaaataatcaggtcactcacgaagaaggtaaaagctcttgaatccaatcaaatggaatgccaaacagctctccaaaagacccaactacagcttcaggaaatggctcaaaaggcaacgcattcttctcttctctctgaagaccttgaggctagaaacgaaactctcagcaacacgttagtggaactttctgcccaggtaggacagctacaagctcgagaacaagctcttacgacaatgataaagctaaaggacaaagatattattgaggcagttaatcacattgcagattgttcgggtaaatttaaaatgctagagcatgccctacgtgatgccaagatggcggagacttgtattgtgaaagaaaagcaagattataagcagaaattgaaggcacttaagattgaagtcaacaaactaaaagaggacctcaatgaaaagacgacagaaaataatgagcaacgagaagagatcattcgcctcaagcaagagaaaagttgcctgcacgatgaattgctttttactgtagagagagaaaagaggaaagatgaattgcttaatattgcgaagtcaaagcaagaacgcacaaattcagaactgcacaatctgagacagatttatgtaaaacaacagagtgatctgcagtttcttaatttcaatgtggaaaattctcaggaattaatacagatgtatgactcaaagatggaggaatcaaaggctctggactccagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgagcacactgctgcccatcagccatgagaatctcactggcagtgccacaaataagtcagaggtcccagaagagtcagctcaaaaaaatacctttgtcagttattgaaggaaacaaaaggcaacttcagtattcatcgtgatcacgaatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaaccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaaaaatatgtttccttggtttctttttattttacaggagtaaaataaggaaggaacgttcatcactttaaactgaacctggcaagttaatttcctcaggaatggggatgtatttttttaagcattgcagatatcaaagttctattgtgctgaataaatgcccctttgttaacaggtctcagtgttacttcagagatgattttcatgagcggggaagagccacctcatttagcctttttaattagggtgctgaaaagagaagttgggtgaggtttggttatgttctttatcaatgcgtgctttctccctcaggctgggct

SEQ ID NO: 6371 - DNA, 2339 bp, Homo sapiens
atgccaaacagctctccaaaagacccaactacagcttcaggaaatggctcaaaagtagagagagaaaagaggaaagatgaattgcttaatattgcgaagtcaaagcaagaacgcacaaattcagaactgcacaatctgagacagatttatgtaaaacaacagagtgatctgcagtttcttaatttcaatgtggaaaattctcaggaattaatacagatgtatgactcaaagatggaggaatcaaaggctctggactccagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgagcacactgctgcccatcagccatgagaatctcactggcagtgccacaaataagtcagaggtcccagaagagtcagctcaaaaaaatacctttgtcagttattgaaggaaacaaaaggcaacttcagtattcatcgtgatcacgaatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaaccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaaaaatatgtttccttggtttctttttattttacaggagtaaaataaggaaggaacgttcatcactttaaactgaacctggcaagttaatttcctcaggaatggggatgtatttttttaagcattgcagatatcaaagttctattgtgctgaataaatgcccctttgttaaca

SEQ ID NO: 6372 - DNA, 2936 bp, Homo sapiens
ggttggagtacggggcgggggtcggccgagggcgcggggccccggggctccgggctcgcccccgccgctcggggcaggcgcgccgatggcgtttctgaggtgacgccgcccacaccgggcttctccgggggcggaggaaacacctatgaaccctccggcagccttccttgccgggcgccagaacatcgggtcagaagttgagatttccactatcgagaaacaacggaaggagctgcagttgctcattggagaattaaaagatcgagataaagagctcaatgacatggttgcagtgcaccagcaacagcttctttcatgggaagaggatcggcagaaagtgttgacactggaagaacgttgcagcaaattagaaggtgaactacataaaagaactgaaataatcaggtcactcacgaagaaggtaaaagctcttgaatccaatcaaatggaatgccaaacagctctccaaaagacccaactacagcttcaggaaatggctcaaaaggcaacgcattcttctcttctctctgaagaccttgaggctagaaacgaaactctcagcaacacgttagtggaactttctgcccaggtaggacagctacaagctcgagaacaagctcttacgacaatgataaagctaaaggacaaagatattattgaggcagttaatcacattgcagattgttcgggtaaatttaaaatgctagagcatgccctacgtgatgccaagatggcggagacttgtattgtgaaagaaaagcaagattataagcagaaattgaaggcacttaagattgaagtcaacaaactaaaagaggacctcaatgaaaagacgacagaaaataatgagcaacgagaagagatcattcgcctcaagcaagagaaaagttgcctgcacgatgaattgctttttactgtagagagagaaaagaggaaagatgaattgcttaatattgcgaagtcaaagcaagaacgcacaaattcagaactgcacaatctgagacagatttatgtaaaacaacagagtgatctgcagtttcttaatttcaatgtggaaaattctcaggaattaatacagatgtatgactcaaagatggaggaatcaaaggctctggactccagcagagacatgtgtttatcagaccttgaaaataaccacccaaaagtcgatattaagagggaaaaaaatcagaagtcactgtttaaggaccagaaatttgaagccatgttggttcagcaaaataggtcagacaagagctcttgcgatgaatgcaaagagaagaaacaacagatcgatactgtgtttggggagaaaagtgtaattacgctgtcatccatattcaccaaagacttagtagagaaacacaacctcccttggtctctgggaggaaaaacccagattgaacccgaaaacaaaattacattgtgcaagatccacacaaaatcaccaaaatgtcatggcactggggttcagaacgaaggaaaacaaccctcagaaacacccactttatctgatgagaagcagtggcatgatgtcagtgtttacctgggcctgaccaactgtccaagttcaaaacatccagaaaagctggatgtagaatgtcaagatcagatggaaaggtccgaaatctcatgctgccagaaaaatgaagcctgtctgggcgaaagtggcatgtgtgactccaagtgctgccacccgagtaacttcataattgaagccccaggccacatgtctgacgtggagtggatgagtattttcaagccttccaaaatgcagagaattgtccgcctcaaatctgggtgcacctgttcagaaagcatctgtggcacacaacatgactccccggcaagtgagctaattgccatccaagattcccactctttgggttcttcaaaatctgccttgagagaagatgagacggagtcctcttccaataaaaagaactcacctacgagtttgttaatctacaaagatgcaccagcattcaatgaaaaggcttcaattgtgttaccctcccaggatgatttctcgcccacgagcaagctccagcgtttgctggcggaatctcgtcagatggtgacggacctggagctgagcacactgctgcccatcagccatgagaatctcactggcagtgccacaaatatttctcatctatgtggaaggcagaaagcagacaccaatactgaatgaatacttaaccgtaaaactgaaagaggattctagttcttcataaacggcacttaattccagctgggagcagaactagaaagttaatttttaaacatctacacttcattttcaagttaaccatttttgtgctgaagaaatattttcatgtgtaagaaagtagaccttattgtacatatagaaagttggaattatgctaagaatgaaaaagacttctctgtaaagatacggactacagttaaatgctagagaagctctttaaaaatgtgaatgtcaaatagagaaagaaccctgcatagaaagtgctgttttaactatctgatttttaaaaaatctgtgcatacatttaaattctaaacaatagcttatcagagtcagctcaaaatatatgagaaacagtattctctcatggttttagcttttgactttgctgtgtaaatagacataaggtgctttgatataaaatataaaatgtaactggaaaatagctcgaggtccttctgtcccaagctgagcagagccccatctttctgggtctatattagtcccacctactgacacaaacaaaagcttgctggaagatcgagttttagacgcatttttaaaaatcttaaagactaaaacacttccattttaacttgtaaagtaatttaattttttaaagattatactatatgcctctgtgtcttctctaaaagaatagatcaacttcagtccataaaagatatttttaatattaaagaaa

SEQ ID NO: 6373 - DNA, 2084 bp, Homo sapiens
gatatcctcgttgctaggagactagacgcgtcttacagtgggagagctcagcctcactgatagccggggatctctcctgttcgagggctgagatctccggtcccacaaccgcccacaaccaggggcacttctggaagtcccctttctagggacatttttcttctaagctctgtaacgcgggccgaggcagaccgaggcttctttcccggatccaatcccctgcccccatgcctaagaaagaaaaaatggccaagacgcccctgtccgatgagaagcagctgcttctgtttcagcagaagttgctggcagaggaggagatggccaaaaagaaggagaggctcctcagccagttcttgaaggacaagctggccaaggaggaacacaacagtgctctgaaccttaataagattaacacacagtggagaactgtccttcgggaagtcaagaccagagaacttcataaggacattgagatcctcagccaaacatttgaacgagtggtggactgtaaggacaatgtcatcaagtctttagctaaagacctgtccgaagccgaggagcagtacgcccatgccctgcgcagccacttgcacaatgttgaccagctcttggccctgcagaggcaccggctcagtctcctggaggaaagttacaacatggagctggaagccctaaccaaggagtttgagacagaaaggaagacaattattgaccaacatgagaaagagattcactatctgcaagatatcttcatggccatggagcagaactatatagattctgagtatgaaagcaagctggagttccagagcatgtggaatgatctcaaaaacatgaatttagaagagaagcactttctaagactgcacctggagaacagagtagaagatctgtggagaaagttccaggatgtactcaagaattacactgatgccacagaggatcgaaaggctgcctttgagaccctgcaggtgaaggatgagaagagctccaaagagattgaagtacagatgaaaaaaatacagaaactacaggatgccataactatttcaaaaggcaagatcatgatacacagccgtgagagtgaagatgagaaccggtatatccgtaatgacaaggaattggtccttgtacaactgcgaaaacttaaggcccaaagaactcaggcccgggcagcatcccagaagaacttagtcagactcaccctggaaagtaatgccaccctcaaggccctgagaaagattgttgataagggtgaaaagatccttaaacttgctgaaatatgtaggaaatttgaaaccgaagaagaaaaagtgctgcctttttattcatcagtattgactcctaaggagcaggaggggattcagaagaataatctagaagagcttactgaggagctcaccaaggtgatggtggactacataggaatggagaatttctggaaaaggtacaacaaagtgaaactggagcaactgagcctccaacatagacgagcccagctgctagatatcaatgggaagctgcgggagatgctgaagcagtacttggatggcatctcagtgagtgacgaagtgctgagccagctcaacccactctttatagtcaactatcaaagcaacttactccagcccttgtccatacgtatagcccatccaggcagcacaagcccatctgcaccctggagggaccagagaaggagctttttccttggatcaagttagaagaaatccaaacaacagagaaaggtgagatgattcttggaaagataggagagttggcccacccctggctggagatacaacttaatcacagaaccattgctagaaaagcctccacactcaaaggtgtctctgtcagtgtgtaggagaaaccctaccacagtacctgggcttccaagactcatggggcacccaccatgcccagcttgattaaagacaatggtgtttattaattcatccatttgttcatcaaggttgcatgactattatgtgccaaagaataagcagaacactgctctttaaatgttcttaagtgtttatttataacaggttgttaataaagtaaaagcctgagttggcatatat

SEQ ID NO: 6374 - DNA, 1775 bp, Homo sapiens
gggagagctcagcctcactgatagccggggatctctcctgttcgagggctgagatctccggtcccacaaccgcccacaaccaggggcacttctggaagtcccctttctagggacatttttcttctaagctctgtaacgcgggccgaggcagaccgaggcttctttcccggatccaatcccctgcccccatgcctaagaaagaaaaaatggccaagacgcccctgtccgatgagaagcagctgcttctgtttcagcagaagttgctggcagaggaggagatggccaaaaagaaggagaggctcctcagccagttcttgaaggacaagctggccaaggaggaacacaacagtgctctgaaccttaataagattaacacacagtggagaactgtccttcgggaagtcaagaccagagaacttcataaggacattgagatcctcagccaaacatttgaacgagtggtggactgtaaggacaatgtcatcaagtctttagctaaagacctgtccgaagccgaggagcagtacgcccatgccctgcgcagccacttgcacaatgttgaccagctcttggccctgcagaggcaccggctcagtctcctggaggaaagttacaacatggagctggaagccctaaccaaggagtttgagacagaaaggaagacaattattgaccaacatgagaaagagattcactatctgcaagatatcttcatggccatggagcagaactatatagattctgagtatgaaagcaagctggagttccagagcatgtggaatgatctcaaaaacatgaatttagaagagaagcactttctaagactgcacctggagaacagagtagaagatctgtggagaaagttccaggatgtactcaagaattacactgatgccacagaggatcgaaaggctgcctttgagaccctgcaggtgaaggatgagaagagctccaaagagattgaagtacagatgaaaaaaatacagaaactacaggatgccataactatttcaaaaggcaagatcatgatacacagccgtgagagtgaagatgagaaccggtatatccgtaatgacaaggaattggtccttgtacaactgcgaaaacttaaggcccaaagaactcaggcccgggcagcatcccagaagaacttagtcagactcaccctggaaagtaatgccaccctcaaggccctgagaaagattgttgataagggtgaaaagatccttaaacttgctgaaatatgtaggaaatttgaaaccgaagaagaaaaagtgctgcctttttattcatcagtattgactcctaaggagcaggaggggattcagaagaataatctagaagagcttactgaggagctcaccaaggtgatggtggactacataggaatggagaatttctggaaaaggtacaacaaagtgaaactggagcaactgagcctccaacatagacgagcccagctgctagatatcaatgggaagctgcgggagatgctgaagcagtacttggatggcatctcagtgagtgacgaagtgctgagccagctcaacccactctttatagtcaactatcaaagcaacttactccagcccttgtccatacgtatagcccatccaggtgataaacaacatccaaccacttaaaatataattgaagcagcccagatgatcttccacaacctgtgatctaaggaaaaaaatctttcaactcctagagatttttttttttttttgagaaatgtagggatgttgctattaaaaatttccatggagttt

SEQ ID NO: 6375 - DNA, 3849 bp, Homo sapiens
aacaggagctagaggcgcgcttcgctgaggaaataaatattaatatggaaagcaacttcaatactgagtcatcatctacttttactcttcaaagttcttcagagacattgttttctattcagctattagatttcaaaacaagtttactggaggcattagaagaattgcgtatgagaagggaagcagaaattcattatgaagagcagattggtaaaattattgtggagacacaggaacttaaatggcaaaaggaaactcttcagaatcaaaaggaaacattggcagagcaacacaaggaagcaatggcagtttttaaaaagcagttgcagatgaagatgtgtgccctggaagaagaaaagggaaaatatcaacttgctacagaaataaaggaaaaagaaatagaaggattgaaggaaacattaaaagcactacaggtttctaaatactctttacagaagaaagtgagtgaaatggaacaaaaggtccagttacatcttctggctaaagaagactatcataagcaactgagtgaaattgagaaatattatgccacaataacaggtcaatttggattggtaaaagagaatcatgaaaagttagaacaaaatgtacgggaagcaatacaatcaaacaaaagactttcagctttaaataaaaaacaagaagctgaaatatgcagtttaaagaaggaactaaaaaaagcagcctcagacttgataaagtccaaagtcacatgtcaatataagatgggagaagaaaacatcaatctaacaattaaagaacaaaaatttcaagaacttcaagaaagactcaacatggaattggaattaaatgagaagattaatgaagagattacccatattcaagaagaaaaacaggatatcatcatttctttccaacatatgcagcagttacttcggcaacaaattcaagctaatactgaaatggaggcagaattgaaggtgctaaaagaaaataatcagacccttgaaagagataatgagctgcaaagggagaaggtaaaagaaaatgaagaaaagtttcttaatcttcaaaatgagcatgaaaaagcactaggaacttggaaaagacatgctgaagaacttaatggagaaattaataagattaaaaatgaattatcatcccttaaagaaactcatattaagttacaagaacattataacaaattatgcaatcaaaaaacatttgaggaagacaaaaagtttcagaatgttccagaagtaaataatgaaaacagtgaaatgtcaactgaaaaatcagaaaacaccattatacagaaatataatactgagcaagaaataagggaagaaaatatggagaatttttgttcagatactgaatacagagaaaaagaagaaaaaaaagaaggctcatttatagaggaaataattatagatgatttacagctttttgaaaaaagcttcaagaatgaaattgatactgttgtttctcaggatgaaaatcaaagtgaaatctccttaagcaaaaccctctccttagataaagaagtaattagtcaaggacaaacctcgaatgttacggacaacagaaaatcagttactacagaaataaaagacaagatatgcttggaaaaagacaatggatgtacagaatttaaatcaccaaataatcattttgtagtgttagatacagcaatagaaacagaaaaaatacatctagaaagaaccagaggattagatgttcaccatacagatgtaaatctggaggttgaaaataacaaaacatcatttaacagtattttaaatgagacagcacacaatacatatcacaataataataaagatgtttctgaaaatgagccattcaaacaattcagattgcttccagggactcgagaacatgctctagagaaggaaattacaaatagtgaccaaaccaaagcagatttggactcgtctctagatataaaaaaaaatcctgttccatgtcagaaatatagtttacggaattcaagtaatgttatgttagatgataaacaatgtaaaataaaacaaatacaactgttaactaaaaaaagtgagtgcagcatattactttctaaacaaacttcagattttctgcaagtctgtaatgatactttagagaaatctgaactaactgttccctgtgatatagtaatcgaccaccatgtttcatatgctgcttttagtgctaattcaaaactacttctgaagaactcagataaaaatgtccatagtatgtctatgttggtgaaacctaactcaagccctgggggaaaaactatgtgtaaaaatatgagtgatatgcaaaacagtcaatttaataactgtttgggatacttagaaaacactaatgtgaacatttcccatcttcatcttaacaatgagaatagtcatgcttcacaagccaaagatgtgaaaactgctgttcacatgaaaacttgcacagaaacagagttttccaataaaaagaatcagattgatgagaatcaggtaactgaagccacaaaaaatgacctcttcctttttgtgagcattaatgaaagacagcatacattgttaaataatacagagaaaacagaatcattaaatgacattgtttcaggaaaaatgttcagtgaaggacagctggaggaatcacattcatttcacatagagccatctggagatttagtaaacagaagcggaaggtcaacctttgatctttcaacttcagataaaaaaactgagaaaactccagtatacatgaatttttcagaccccggtccttggtcaaaagtaaatcacattgaaagtcaaacagcgagcagttcgaccccttgcatttctttgttgctgaaggagagaccactagatccatcagaaaacaaaaagatcatttcaatggctctttgtaaaaatattggtgtggatgatgttggaaaggatattggaccagatactaccagcattaacagagttgctgacactttgaataactggagtatccatccagatcccaagggagaacccagtgaagagaagaatgcaatggcaaagactttttatgattcctcttttcccacagaacatgtgaaaacaaagcctctgatatcaactccactacaaagccatttgcaggcaatcaagacgactaaaaatacttctggtgatgatgactggcagagcctcattacgaatcaactaaataaaagtgaaaatttactaagtttagaaaatgacaaccagccaaagaaaagaaaagcagaagagacgttggaaaaaaacaacagattaaaataatgtagataagtgctttcagtagtgaaattatgtaactgaaattctggtatagtttttactagaataaaatgactgttgtatttaaagctctacagtttgtctttgcttttccaagtttttctaatgtgaagaaattgtattactctacttctgtcttctctctgtatattatcctttctttaaagtgctcattgcttcttcaatatccttttttaaagaacagaatttatgtattgtatgacagacattgtgaccccttgtaatttattacttcatatcctctggagtttgtgattttagtataaatttgagacaataactgtccagactaggcaaatttttttagtttataatgttttactatgatttagggcttttttttcaaagaacaaaaattataagcataaaaactcaggtatcagaaagactcaaaaggctgtttttcactttgttcagattttgtttccaggcattaagtgtgtcatacagttgttgccactgctgttttccaaatgtccgatgtgtgctatgactaaaaattgaaaaattaaacacagtgttagtc

SEQ ID NO: 6376 - DNA, 3213 bp, Homo sapiens
ctgcccgcgcgctccacggtgcagagctctaagcgcgcgggctggcaggctgcggcgcgtcaaggtcagcctggagctgggtggcggcctgcctgggggcgggggaccctactggaggcccgggctggggcctcccagcgcctcggccatattgaatagcttcgactggaccgtctttgtctgcgaagtcctgtcccaagttccagccgcgtccctggggcctggggcaggaagagtcgctggcagcccgcgcgccccaacttggagctgggacaccacgtttccagcttggagtgggccttgagccttgggactgacctcgcccccggctcacgtaggcatcctggaaattgattcccccaagtccttggtgggggagccggacttggtcaagactgtacttgttgcaggcgaagagattggaggcgtttggctcgtccctggctagggaggtgagactctccggtcagcgttgctggaactccccccatccagtccctccctcaagactaagggctacagtagtttgttggggctcattgccccctcaccccagatatcaccctggagatcttaaagactctcgagaaaagccacgtggggggctggttcccctggggcttcctgccgtcccccgactgcctcattctttggagcgtccccgatgtctgcaaagatgtggatttggacgtcctcgtggaagccctaaagcccgtggggacatttaagaagatcggcaaggtgttccgcaaggaggaggactccacggtggggatgctgcagatcggggaggacgtcgactatttgctcatcccccgggaggtcaggctggctgggggcgtctggagagtcatctctaagcccgccaccaaggaagcagaatttcgggagcggctgacccagttcctggaagaagagggccgcaccctggaggacgtggcccgcatcatggagaagagcaccccgcacccgccccagccccccaaaaagcccaaggagccccgagtgaggaggagagtgcagcagatggtgactcctccgccccggctggtcgtgggcacgtacgacagcagcaacgccagcgacagcgagttcagcgacttcgagacctccagagacaagagccgccagggcccgcggcggggcaagaaggtgcgcaaaatgcccgtcagctacctgggcagcaagttcctgggaagcgacctggagagtgaggatgatgaggaactggtcgaggccttcctccggcgacaggagaagcagcccagcgcgccgcctgcccgccgccgcgtcaacctgccagtgcccatgtttgaggacaacctggggcctcagctgtccaaagcggacaggtggcgggagtatgtcagccaggtgtcctgggggaagctgaagcggagggtgaagggttgggcgccgagggcgggccccggggtgggcgaggcccggctggcctccaccgcagtggagagcgcaggggtatcatcggcgccagagggcaccagcccgggggatcgcttgggaaacgcgggagatgtttgtgtgccccaggcttcccctaggcgatggaggcccaagatcaactgggcctcctttcggcgccgcaggaaggagcagacagcacccacaggtcagggggcagacatcgaggctgatcaggggggagaggctgcagatagtcaaagggaagaggccatagctgaccagcgggaaggggctgcaggtaatcagagggcaggggccccagctgaccagggggcagaggctgcagataatcagagggaagaggctgcagataatcagagggcaggggccccagctgaggagggggcagaggctgcagataaccagagggaagaggctgcagataatcagagggcagaggccccagctgaccagaggtcacagggcacagataaccacagggaagaggctgcagataatcagagggcggaggccccagctgaccaggggtcagaggttacagataatcaaagggaagaggccgtacatgaccagagggaaagggccccagctgtccagggtgcagataatcagagggcacaggcccgggctggccagagggcagaggctgcacataatcagagggcaggggccccaggtatccaggaagctgaagtctcagctgcccaagggaccacaggaacagctccaggagccagggcccggaaacaggtcaagacagtgaggttccagacccctggacgcttttcgtggttttgcaagcgccggagagccttctggcacactccccggttgccaaccctgcccaagagagtccccagggcaggagaggccaggaacctcagggtgctgagggccgaggccagagcagaagctgagcagggagagcaagaagaccagctgtgaggtgagggctagagacagcccacgggccctccctccaagtgtgggagggagagatgctctgcctctgaacttcaaagtggaggtggagtgctggccacgtctccacctaacaaccctctttattctcttgttaaagttttgttcatgctttgatttttttttaaattttttagagacagggtctcactctgttgcccaggctggagtgcagtggcatgatcataactcactgcagcctcaaacttctggcctcaagtgatcctcctgcctcggcctcccaaaatgctgggattacagatgtgagccaccacacacaccatctgattaaaaaaaaaaaatactgattccttgtagcaacccaaaaaatgtaaagaaagaattcgacacaatggggttgcgtcacctatagttttcatttcctcaaatgcaactcaaggtgctcagcttgataaagggagagagggagggcaggggagaaactgactcctttttccatctcttttttgcctgcacacttaatgtggactgcctccttggacttaaaaagagttgagccaacatgcaaatcaaaaaacatttatgaactgatttcttagctttggacttgacaactgacgaatgctctgggggtgacctggcccttgctgtccgttccactcccatccttgatgatggagacacctgtgtttatgttgtcacttcgcttgccatcctcatgccccgggctctgctggtttggaggggacagggcccttggtttgcacacctcacccgatcttggttataaggtacagtaaaagcgtctgaaaaatgcattcaaaa

SEQ ID NO: 6377 - DNA, 2097 bp, Homo sapiens
acggtgcagagctctaagcgcgcgggctggcaggctgcggcgcgtcaaggtcagcctggagctgggtggcggcctgcctgggggcgggggaccctactggaggcccgggctggggcctcccagcgcctcggccatattgaatagcttcgactggaccgtctttgtctgcgaagtcctgtcccaagttccagccgcgtccctggggcctggggcaggaagagtcgctggcagcccgcgcgccccaacttggagctgggacaccacgtttccagcttggagtgggccttgagccttgggactgacctcgcccccggctcacgtaggcatcctggaaattgattcccccaagtccttggtgggggagccggacttggtcaagactgtacttgttgcaggcgaagagattggaggcgtttggctcgtccctggctagggaggtgagactctccggtcagcgttgctggaactccccccatccagtccctccctcaagactaagggctacagtagtttgttggggctcattgccccctcaccccagatatcaccctggagatcttaaagactctcgagaaaagccacgtggggggctggttcccctggggcttcctgccgtcccccgactgcctcattctttggagcgtccccgatgtctgcaaagatgtggatttggacgtcctcgtggaagccctaaagcccgtggggacatttaagaagatcggcaaggtgttccgcaaggaggaggactccacggtggggatgctgcagatcggggaggacgtcgactatttgctcatcccccgggaggtcaggctggctgggggcgtctggagagtcatctctaagcccgccaccaaggaagcagaatttcgggagcggctgacccagttcctggaagaagagggccgcaccctggaggacgtggcccgcatcatggagaagagcaccccgcacccgccccagccccccaaaaagcccaaggagccccgagtgaggaggagagtgcagcagatggtgactcctccgccccggctggtcgtgggcacgtacgacagcagcaacgccagcgacagcgagttcagcgacttcgagacctccagagacaagagccgccagggcccgcggcggggcaagaaggtgcgcaaaatgcccgtcagctacctgggcagcaagttcctgggaagcgacctggagagtgaggatgatgaggaactggtcgaggccttcctccggcgacaggggctgcaggtaatcagagggcaggggccccagctgaccagggggcagaggctgcagataatcagagggaagaggctgcagataatcagagggcaggggccccagctgaggagggggcagaggctgcagataaccagagggaagaggctgcagataatcagagggcagaggccccagctgaccagaggtcacagggcacagataaccacagggaagaggctgcagataatcagagggcggaggccccagctgaccaggggtcagaggttacagataatcaaagggaagaggccgtacatgaccagagggaaagggccccagctgtccagggtgcagataatcagagggcacaggcccgggctggccagagggcagaggctgcacataatcagagggcaggggccccaggtatccaggaagctgaagtctcagctgcccaagggaccacaggaacagctccaggagccagggcccggaaacaggtcaagacagtgaggttccagacccctggacgcttttcgtggttttgcaagcgccggagagccttctggcacactccccggttgccaaccctgcccaagagagtccccagggcaggagaggccaggaacctcagggtgctgagggccgaggccagagcagaagctgagcagggagagcaagaagaccagctgtgaggtgagggctagagacagcccacgggccctccctccaagtgtgggagggagagatgctctgcctctgaacttcaaagtggaggtggagtgctggccacgtctccacctaacaaccctctttattctcttgttaaagttttgttcatgctttgatttttttttaaattttttagagacaggg

SEQ ID NO: 6378 - DNA, 9667 bp, Homo sapiens
gttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgtaacaa

SEQ ID NO: 6379 - DNA, 9505 bp, Homo sapiens
cgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgtaacaa

SEQ ID NO: 6380 - DNA, 2880 bp, Homo sapiens
cttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaatttta

SEQ ID NO: 6381 - DNA, 6378 bp, Homo sapiens
gccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaag

SEQ ID NO: 6382 - DNA, 4236 bp, Homo sapiens
aaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaatactacatcctttgaagacataagtccacaaggtgttagtgatgattctagtacgggatcaagagttcatgcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatat

SEQ ID NO: 6383 - DNA, 9811 bp, Homo sapiens
attggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacagtgaaaaaaaattatgaagctctcaaacagagacaagatgaggaaaggatggtacagagctctcctccaatatctggtgaagacaacaaatgggagcgagaaagtcaagaaacgactagagaacttctgaaagttaaagacagattaattgaagtagaaagaaataatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacgttaaatcattttgaaaatcttggatgaaaggtgctatgtaaatggaaatacaaaggattcttactaacatacaaaaataatgcacaacagaaatatctaaaaccttttccgtagactttgaaacatctctctctctcataactccctggattcaagtagcacattggtaataggtatcagagcagtctagagacaattgcatgtcaaaaaatgtacattcatttttaggtggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattacagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgt

SEQ ID NO: 6384 - DNA, 3024 bp, Homo sapiens
gctgagtgtccccaggcacctgattcagacccacaggaggcagagagtccccttcaggcagctgccatggacccccaggcctcagactggtccccgcaagagtcaggctctcctgtggagacacaggagtccccggagaaggctggccgtagatcctctctccagagccctgcctctgtggccccacctcagggtccagggaccaaaattcaggccccgcagttgctgggaggagagacagagggaagagaggctccccaaggcgagttggtgcctgaggcctgggggttgagacaggagggccctgagcacaagccagggccttcggagcccagctctgtgcagctggaggagcaggagggcccaaaccagggcctggacctggccacgggacaagcagaggccagagagcatgaccagaggctggaagggacggtcagggacccagcctggcaaaaaccacagcagaagtcagaaggggctcttgaggtccaggtctgggaaggcccaatcccaggggagagcctggccagtggtgtcgcagagcaggaggccctcagggaggaggtggcacagttgaggagaaaggctgaggcccttggagatgagctggaagcccaggcccgcaagctggaggcccaaaacacggaggctgcccgcctctccaaggagctggcccaagcgcgaagggcagaggccgaggcccaccgggaggcagaggcccaggcctgggagcaagcccggctgcgggaggcagtggaggctgctggccaggagctggagtctgcgtcccaggaacgggaggcgctggtggaggcgctggcagcagcgggccgggagcggaggcagtgggagcgtgaggggtccaggctgcgggcccagtcggaggccgccgaggaacggatgcaggtgctggagagcgagggccgccagcacttggaggaggctgagagggagcgccgggagaaggaggccctccaggcggagctggagaaagctgtggtgcggggcaaggagttgggggaccggctggagcatttgcagcgtgagctggagcaggcggctctcgagcgccaggaatttctgcgagaaaaggaaagccagcaccagaggtaccagggcttggagcagcggctggaagctgagctgcaggcggcggcgaccagcaaggaggaggcgctgatggagctcaagaccagggccctgcagctggaagaggagctgttccagctgcgccagggccccgcggggctggggcccaaaaagcgtgcggagcctcagctggtggagacccagaatgtgcggcttattgaggtggagcgcagtaatgcgatgctggtggcagagaaggcagctttgcaggggcagctgcagcacctggaggggcagctggggagcctgcagggccgtgcccaggagctgctgctgcagagccagcgggcgcaggagcacagcagccgcctgcaggccgagaagtctgtgctggagattcagggccaggagctgcaccggaagctggaggtgctggaggaggaggtgcgggcggcacggcagtcccaggaggagacccgcgggcagcagcaggccctgcttcgggaccacaaggccctggcacagctgcagcggcggcaggaggccgagctagagggactgctggtgcggcaccgagacctcaaggccaacatgcgggcactggagctggcccaccgggagctgcagggccggcacgagcagctgcaggcccagcgggccagcgtggaggcacaggaggtggccctgctggcagagcgtgaacgcctgatgcaagatgggcatcggcagcggggcctggaggaggagctgcggaggcttcagagcgagcacgacagggctcagatgctgctggcagagttgtctcgggagcggggtgagctgcagggtgaacgcggggagctacggggccggctggcgcggctggagctggagcgggcacagctggagatgcagagccagcagctgcgcgagtccaaccagcagctggacctgagcgcctgccggctgaccacgcagtgtgagctattgacacagctgcgaagtgcccaggaagaggagaaccggcagctgctggctgaagttcaggccctgagccgggagaacagggagctcctggagcgcagcctggagagtcgggaccacctgcaccgcgaacagcgggagtacctggaccagcttaatgccctgcgccgcgagaagcagaagctcgtggagaagatcatggaccaataccgcgtgctggagcctgtgcccctgccccggaccaaggtccccttccccggcacccatgcgccgggcccagagctccctctgcctgcgggatgagaccttggcaggcgggcagcggcggaaactcagctcaaggttcccggtggggcgaagctctgagtcattcagccctggggacacccctaggcaacgattccgacagcgccatccaggccccctgggggcgcccgtctcccacagcaaaggacctggtgtgggatgggagaactccgctgagaccctgcaggaacacgaaacagatgccaaccgagagggccctgaggtacaggaaccggagaaacgtcccctcaccccatccctcagccagtgacaccgtgggaacagcaggcttgggagtgcagccttctcggcactggagtgtcagcggaggccccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagcctt

SEQ ID NO: 6385 - DNA, 4915 bp, Homo sapiens
ggcaggtgcagctgccacagtgagacgggcaccccgacccgggcatggaggggggcaaggggcccaggctcagagacttcctgagtgggagtctggctacctgggcgctgggactggccgggctggtcggggaggcggaggactcggagggggaagaagaggaagaggaggaagagccgcccctttggttggagaagagattcctgcgcctcagcgatggggccctgctcctccgggtgctgggcatcattgcccccagctcccgagggggacctcggatgctcagaggccttgacggacctgctgcctggcgagtgtggaacctgaaccacctgtggggccgactgagggacttctaccaggaggagctgcagctgctgatcctgtcgccacccccagacctccagacattgggatttgaccctctctcagaagaagcggtggagcagctggaaggcgttcttcggctactgttgggagcgtcagtacagtgtgagcaccgggaactcttcatccgccacatccagggcctcagtctcgaggtccagagcgagctggccgctgccatccaggaggtgacccagccgggggccggcgtggtgctggcactgtctgggccagatcctggggagctggcacctgccgagctggagatgctgtcccggagcctgatggggacactgtcgaagctggcacgggagcgtgacctgggggcccagcggctggctgaactgctgctggagcgagaacccctctgcttgaggcctgaggctccctctagggctcccgccgagggcccctcgcaccatctggccctgcagctggccaacgccaaggctcagctgcggcgtctgcggcaggagctggaggagaaggccgagctgctgctagactcccaggccgaggtgcagggtttggaggccgaaataagaaggctccgccaggaggcccaggcgctgtcgggacaggccaagcgggccgagctgtaccgcgaggaggcagaggcgctgcgggagcgggccggccgcctgccccgcctgcaggaggagctgaggcgctgccgcgagcggctgcaggcggctgaggcctacaagagtcagctggaggaggagcgggtgctctcgggggtgctggaggcgtccaaggcgctgctggaagagcagctggaggctgcccgagagcgctgcgcccggctgcacgagacccagcgcgagaacctgctgctgcgaacccggctgggcgaggcccatgcggagctggactctctgcggcatcaggtggaccagctggctgaggagaatgtggagctggagctggagcttcagcggagcttggagccacctccaggatcccctggggaggcacccctagcaggagcggccccctcgctgcaagatgaggtgagggaggcagaggctgggcggcttcggacccttgagagggagaaccgggagcttcgggggctgcttcaggtgcttcaggggcagccagggggccagcaccccctgctggaggcaccgagagaggaccctgttcttccagtgctggaggaggctccccagactcctgtggccttcgaccacagccctcagggcttggttcagaaggcaagggatggaggcccccaggccttggacttggctcccccggcattagactcagtgctcgaggcatcagctgagtgtccccaggcacctgattcagacccacaggaggcagagagtccccttcaggcagctgccatggacccccaggcctcagactggtccccgcaagagtcaggctctcctgtggagacacaggagtccccggagaaggctggccgtagatcctctctccagagccctgcctctgtggccccacctcagggtccagggaccaaaattcaggccccgcagttgctgggaggagagacagagggaagagaggctccccaaggcgagttggtgcctgaggcctgggggttgagacaggagggccctgagcacaagccagggccttcggagcccagctctgtgcagctggaggagcaggagggcccaaaccagggcctggacctggccacgggacaagcagaggccagagagcatgaccagaggctggaagggacggtcagggacccagcctggcaaaaaccacagcagaagtcagaaggggctcttgaggtccaggtctgggaaggcccaatcccaggggagagcctggccagtggtgtcgcagagcaggaggccctcagggaggaggtggcacagttgaggagaaaggctgaggcccttggagatgagctggaagcccaggcccgcaagctggaggcccaaaacacggaggctgcccgcctctccaaggagctggcccaagcgcgaagggcagaggccgaggcccaccgggaggcagaggcccaggcctgggagcaagcccggctgcgggaggcagtggaggctgctggccaggagctggagtctgcgtcccaggaacgggaggcgctggtggaggcgctggcagcagcgggccgggagcggaggcagtgggagcgtgaggggtccaggctgcgggcccagtcggaggccgccgaggaacggatgcaggtgctggagagcgagggccgccagcacttggaggaggctgagagggagcgccgggagaaggaggccctccaggcggagctggagaaagctgtggtgcggggcaaggagttgggggaccggctggagcatttgcagcgtgagctggagcaggcggctctcgagcgccaggaatttctgcgagaaaaggaaagccagcaccagaggtaccagggcttggagcagcggctggaagctgagctgcaggcggcggcgaccagcaaggaggaggcgctgatggagctcaagaccagggccctgcagctggaagaggagctgttccagctgcgccagggccccgcggggctggggcccaaaaagcgtgcggagcctcagctggtggagacccagaatgtgcggcttattgaggtggagcgcagtaatgcgatgctggtggcagagaaggcagctttgcaggggcagctgcagcacctggaggggcagctggggagcctgcagggccgtgcccaggagctgctgctgcagagccagcgggcgcaggagcacagcagccgcctgcaggccgagaagtctgtgctggagattcagggccaggagctgcaccggaagctggaggtgctggaggaggaggtgcgggcggcacggcagtcccaggaggagacccgcgggcagcagcaggccctgcttcgggaccacaaggccctggcacagctgcagcggcggcaggaggccgagctagagggactgctggtgcggcaccgagacctcaaggccaacatgcgggcactggagctggcccaccgggagctgcagggccggcacgagcagctgcaggcccagcgggccagcgtggaggcacaggaggtggccctgctggcagagcgtgaacgcctgatgcaagatgggcatcggcagcggggcctggaggaggagctgcggaggcttcagagcgagcacgacagggctcagatgctgctggcagagttgtctcgggagcggggtgagctgcagggtgaacgcggggagctacggggccggctggcgcggctggagctggagcgggcacagctggagatgcagagccagcagctgcgcgagtccaaccagcagctggacctgagcgcctgccggctgaccacgcagtgtgagctattgacacagctgcgaagtgcccaggaagaggagaaccggcagctgctggctgaagttcaggccctgagccgggagaacagggagctcctggagcgcagcctggagagtcgggaccacctgcaccgcgaacagcgggagtacctggaccagcttaatgccctgcgccgcgagaagcagaagctcgtggagaagatcatggaccaataccgcgtgctggagcctgtgcccctgccccggaccaagaagggcagctggctggcagacaaggtgaagaggctgatgcggccccggcgggaggggggcccccctggggggctgcgcctgggggccgatggggctggcagcaccgagagcctggggggccccccggagacggagcttcctgagggcagggaggcagatgggacagggtccccttccccggcacccatgcgccgggcccagagctccctctgcctgcgggatgagaccttggcaggcgggcagcggcggaaactcagctcaaggttcccggtggggcgaagctctgagtcattcagccctggggacacccctaggcaacgattccgacagcgccatccaggccccctgggggcgcccgtctcccacagcaaaggacctggtgtgggatgggagaactccgctgagaccctgcaggaacacgaaacagatgccaaccgagagggccctgaggtacaggaaccggagaaacgtcccctcaccccatccctcagccagtgacaccgtgggaacagcaggcttgggagtgcagccttctcggcactggagtgtcagcggaggccccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagccttaactggacatgaggggcatgagaataaagctgaactgcagcctcctga

SEQ ID NO: 6386 - DNA, 2326 bp, Homo sapiens
ctggcagcatcctggcgccccctgcccccccagcccccactgtcagctcctgacttcctgtccctccagccctccgtggccttttccctgtagccaaggtctctcacccgacccacctctgctgagcctctctagctgtctcgctgtcacatggctggggtggcagcccaccgggcgcatccacctttcactgcgcacatgaagaaccgtgggctcagagaggagctggagaaagctgtggtgcggggcaaggagttgggggaccggctggagcatttgcagcgtgagctggagcaggcggctctcgagcgccaggaatttctgcgagaaaaggaaagccagcaccagaggtaccagggcttggagcagcggctggaagctgagctgcaggcggcggcgaccagcaaggaggaggcgctgatggagctcaagaccagggccctgcagctggaagaggagctgttccagctgcgccagggccccgcggggctggggcccaaaaagcgtgcggagcctcagctggtggagacccagaatgtgcggcttattgaggtggagcgcagtaatgcgatgctggtggcagagaaggcagctttgcaggggcagctgcagcacctggaggggcagctggggagcctgcagggccgtgcccaggagctgctgctgcagagccagcgggcgcaggagcacagcagccgcctgcaggccgagaagtctgtgctggagattcagggccaggagctgcaccggaagctggaggtgctggaggaggaggtgcgggcggcacggcagtcccaggaggagacccgcgggcagcagcaggccctgcttcgggaccacaaggccctggcacagctgcagcggcggcaggaggccgagctagagggactgctggtgcggcaccgagacctcaaggccaacatgcgggcactggagctggcccaccgggagctgcagggccggcacgagcagctgcaggcccagcgggccagcgtggaggcacaggaggtggccctgctggcagagcgtgaacgcctgatgcaagatgggcatcggcagcggggcctggaggaggagctgcggaggcttcagagcgagcacgacagggctcagatgctgctggcagagttgtctcgggagcggggtgagctgcagggtgaacgcggggagctacggggccggctggcgcggctggagctggagcgggcacagctggagatgcagagccagcagctgcgcgagtccaaccagcagctggacctgagcgcctgccggctgaccacgcagtgtgagctattgacacagctgcgaagtgcccaggaagaggagaaccggcagctgctggctgaagttcaggccctgagccgggagaacagggagctcctggagcgcagcctggagagtcgggaccacctgcaccgcgaacagcgggagtacctggaccagcttaatgccctgcgccgcgagaagcagaagctcgtggagaagatcatggaccaataccgcgtgctggagcctgtgcccctgccccggaccaagaagggcagctggctggcagacaagggtccccttccccggcacccatgcgccgggcccagagctccctctgcctgcgggatgagaccttggcaggcgggcagcggcggaaactcagctcaaggttcccggtggggcgaagctctgagtcattcagccctggggacacccctaggcaacgattccgacagcgccatccaggccccctgggggcgcccgtctcccacagcaaaggacctggtgtgggatgggagaactccgctgagaccctgcaggaacacgaaacagatgccaaccgagagggccctgaggtacaggaaccggagaaacgtcccctcaccccatccctcagccagtgacaccgtgggaacagcaggcttgggagtgcagccttctcggcactggagtgtcagcggaggccccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagccttaactggacatgaggggcatgagaataaagctgaactgca

SEQ ID NO: 6387 - DNA, 4565 bp, Homo sapiens
ctcagggcaggtgcagctgccacagtgagacgggcaccccgacccgggcatggaggggggcaaggggcccaggctcagagacttcctgagtgggagtctggctacctgggcgctgggactggccgggctggtcggggaggcggaggactcggagggggaagaagaggaagaggaggaagagccgcccctttggttggagaagagattcctgcgcctcagcgatggggccctgctcctccgggtgctgggcatcattgcccccagctcccgagggggacctcggatgctcagaggccttgacggacctgctgcctggcgagtgtggaacctgaaccacctgtggggccgactgagggacttctaccaggaggagctgcagctgctgatcctgtcgccacccccagacctccagacattgggatttgaccctctctcagaagaagcggtggagcagctggaaggcgttcttcggctactgttgggagcgtcagtacagtgtgagcaccgggaactcttcatccgccacatccagggcctcagtctcgaggtccagagcgagctggccgctgccatccaggaggtgacccagccgggggccggcgtggtgctggcactgtctgggccagatcctggggagctggcacctgccgagctggagatgctgtcccggagcctgatggggacactgtcgaagctggcacgggagcgtgacctgggggcccagcggctggctgaactgctgctggagcgagaacccctctgcttgaggcctgaggctccctctagggctcccgccgagggcccctcgcaccatctggccctgcagctggccaacgccaaggctcagctgcggcgtctgcggcaggagctggaggagaaggccgagctgctgctagactcccaggccgaggtgcagggtttggaggccgaaataagaaggctccgccaggaggcccaggcgctgtcgggacaggccaagcgggccgagctgtaccgcgaggaggcagaggcgctgcgggagcgggccggccgcctgccccgcctgcaggaggagctgaggcgctgccgcgagcggctgcaggcggctgaggcctacaagagtcagctggaggaggagcgggtgctctcgggggtgctggaggcgtccaaggcgctgctggaagagcagctggaggctgcccgagagcgctgcgcccggctgcacgagacccagcgcgagaacctgctgctgcgaacccggctgggcgaggcccatgcggagctggactctctgcggcatcaggtggaccagctggctgaggagaatgtggagctggagctggagcttcagcggagcttggagccacctccaggatcccctggggaggcacccctagcaggagcggccccctcgctgcaagatgaggtgagggaggcagaggctgggcggcttcggacccttgagagggagaaccgggagcttcgggggctgcttcaggtgcttcaggggcagccagggggccagcaccccctgctggaggcaccgagagaggaccctgttcttccagtgctggaggaggctccccagactcctgtggccttcgaccacagccctcagggcttggttcagaaggcaagggatggaggcccccaggccttggacttggctcccccggcattagactcagtgctcgaggcatcagctgagtgtccccaggcacctgattcagacccacaggaggcagagagtccccttcaggcagctgccatggacccccaggcctcagactggtccccgcaagagtcaggctctcctgtggagacacaggagtccccggagaaggctggccgtagatcctctctccagagccctgcctctgtggccccacctcagggtccagggaccaaaattcaggccccgcagttgctgggaggagagacagagggaagagaggctccccaaggcgagttggtgcctgaggcctgggggttgagacaggagggccctgagcacaagccagggccttcggagcccagctctgtgcagctggaggagcaggagggcccaaaccagggcctggacctggccacgggacaagcagaggccagagagcatgaccagaggctggaagggacggtcagggacccagcctggcaaaaaccacagcagaagtcagaaggggctcttgaggtccaggtctgggaaggcccaatcccaggggagagcctggccagtggtgtcgcagagcaggaggccctcagggaggaggtggcacagttgaggagaaaggctgaggcccttggagatgagctggaagcccaggcccgcaagctggaggcccaaaacacggaggctgcccgcctctccaaggagctggcccaagcgcgaagggcagaggccgaggcccaccgggaggcagaggcccaggcctgggagcaagcccggctgcgggaggcagtggaggctgctggccaggagctggagtctgcgtcccaggaacgggaggcgctggtggaggcgctggcagcagcgggccgggagcggaggcagtgggagcgtgaggggtccaggctgcgggcccagtcggaggccgccgaggaacggatgcaggtgctggagagcgagggccgccagcacttggaggaggctgagagggagcgccgggagaaggaggccctccaggcggagctggagaaagctgtggtgcggggcaaggagttgggggaccggctggagcatttgcagcgtgagctggagcaggcggctctcgagcgccaggaatttctgcgagaaaaggaaagccagcaccagaggtaccagggcttggagcagcggctggaagctgagctgcaggcggcggcgaccagcaaggaggaggcgctgatggagctcaagaccagggccctgcagctggaagaggagctgttccagctgcgccagggccccgcggggctggggcccaaaaagcgtgcggagcctcagctggtggagacccagaatgtgcggcttattgaggtggagcgcagtaatgcgatgctggtggcagagaaggcagctttgcaggggcagctgcagcacctggaggggcagctggggagcctgcagggccgtgcccaggagctgctgctggcagagcgtgaacgcctgatgcaagatgggcatcggcagcggggcctggaggaggagctgcggaggcttcagagcgagcacgacagggctcagatgctgctggcagagttgtctcgggagcggggtgagctgcagggtgaacgcggggagctacggggccggctggcgcggctggagctggagcgggcacagctggagatgcagagccagcagctgcgcgagtccaaccagcagctggacctgagcgcctgccggctgaccacgcagtgtgagctattgacacagctgcgaagtgcccaggaagaggagaaccggcagctgctggctgaagttcaggccctgagccgggagaacagggagctcctggagcgcagcctggagagtcgggaccacctgcaccgcgaacagcgggagtacctggaccagcttaatgccctgcgccgcgagaagcagaagctcgtggagaagatcatggaccaataccgcgtgctggagcctgtgcccctgccccggaccaagaagggcagctggctggcagacaaggtgaagaggctgatgcggccccggcgggaggggggcccccctggggggctgcgcctgggggccgatggggctggcagcaccgagagcctggggggccccccggagacggagcttcctgagggcagggaggcagatgggacagggtccccttccccggcacccatgcgccgggcccagagctccctctgcctgcgggatgagaccttggcaggcgggcagcggcggaaactcagctcaaggttcccggtggggcgaagctctgagtcattcagccctggggacacccctaggcaacgattccgacagcgccatccaggccccctgggggcgcccgtctcccacagcaaaggacctggtgtgggatgggagaactccgctgagaccctgcaggaacacgaaacagatgccaaccgagagggccctgaggtacaggaaccggagaaacgtcccctcaccccatccctcagccagtgacaccgtgggaacagcaggcttgggagtgcagccttctcggcactggagtgtcagcggaggccccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagccttaactggacatgaggggcatgagaataaagctgaactgcagcctcctg

SEQ ID NO: 6388 - DNA, 1598 bp, Homo sapiens
cgccttctccttgcttctgggggtcgtggccttgctcccgctgtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctggctaggcagctggaagagaaagaccgagtgctaaagaagcaggatgcattctacaaagaacagctggctagactggaggagaggagctcagagttctacagagtcaccactgaacaatatcagaaagctgctgaagaggtggaagcaaagttcaagcgatatgagtctcatccagtctgtgctgatctgcaggccaaaattcttcagtgttaccgtgagaacacccaccagaccctcaaatgctccgctctggccacccagtatatgcactgtgtcaatcatgccaaacagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaaccttggctgataaaacctctatagtgaatactcacatctttacttcactcactatcaataataaatatattttctgacaaaga

SEQ ID NO: 6389 - DNA, 898 bp, Homo sapiens
gtgcgggaaaagaatccaggcccttccacgcgcgtgtgggtgcgggggccccgaagtgctcgtggttccccgctaggtctccgctggggcaggaaccggaatcatgggtgggaccaccagcacccgccgggtcaccttcgaggcggacgagaatgagaacatcaccgtggtgaagggcatccggctttcggaaaatgtgattgatcgaatgaaggaatcctctccatctggttcgaagtctcagcggtattctggtgcttatggtgcctcagtttctgatgaagaattgaaaagaagagtagctgaggagctggcattggagcaagccaagaaagaatccgaagatcagaaacgactaaagcaagccaaagagctggaccgagagagggctgctgccaatgagcagttaaccagagccatccttcgggagaggatatgtagcgaggaggaacgcgctaaggcaaagcacctgataaaagtggagctgctctgggtgaaacctggagtgttgactgcttagcctccacttcggccttcctagaaacccagatgttactcctcggaacctttagtcctcattggagcacagttgggaactcactggacagggaaaatgggaccatggaatggagaactttgaactgaagagtgagggggattttcctagttcactaggcaattgggaaacactaaaactttctaagaagaaggctcatttctagtctctcccattctttaccttagtcacttctctgaaagaccaacccatgaccagctgcaaacagagaacatgaaaggaagtccatgcgtaatgaatcagtttcttcagtgacaaatctggggtcccggttgcatgggcaaatagtgaagccagaatagaggtggtagaccaagaaag

SEQ ID NO: 6390 - DNA, 1684 bp, Homo sapiens
gctacttaaggtcctgctgcgtgagccattgacgtgtttggagctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactgggtatatgtgatgttacctagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttcc

SEQ ID NO: 6391 - DNA, 1535 bp, Homo sapiens
cgctacttaaggtcctgctgcgtgagccattgacgtgtttggagctggagacggcctgggtgctggcgaagcggaggccggagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcattt

SEQ ID NO: 6392 - DNA, 1550 bp, Homo sapiens
ctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactgggtatatgtgatgttacctagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtc

SEQ ID NO: 6393 - DNA, 536 bp, Homo sapiens
gtgtttggagctggagacggcctgggtgctggcgaagcggaggccggaggtgagtggttcccccgccctacctccgaagcggccgcagaaaagcggggagagaggggtgcccttgggccgtagcggggcccgaatgcacttctgcggcgcggaggcgctcccgccaggcttcgccgcagcgcggacctcttcccgttgctcttcctcccgccacacgggtctgttcgctccgggggcgaggaagatgacctctgcctagtccgggcaaccccagctcttcttccactctcctgtgtagcctctgaagcgcagttaccggccccacccccagttccctgcgttttcctcgccccttgtctctctcggcatggtctcggcacagcaagtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaa

SEQ ID NO: 6394 - DNA, 1805 bp, Homo sapiens
gctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactggtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaattcttttgatttgtattgactgctataaaaatgatggattaaaataggaccagaaaagaatgaatgcctacctgtgtaagaagtatttttgtatttttaagcacacttgttaaagggcttggaattttaatgtcactcctttgaaggtacataccaatatcaacattcatcttgtaact

SEQ ID NO: 6395 - DNA, 1670 bp, Homo sapiens
gctggagacggcctgggtgctggcgaagcggaggccggagttaatacacgaggaactcatgcaaaggaggggactttcggaaatccaaacttagagtgccttgtatttagaatccggaaggaaaaggaaatgaaatgtgaagaaactcatgcaccaaactcgaactggtaagaagactgttagaatgccctcggtaacacagaggctgagagatcctgacataaatccttgtttgtcgatcctgttctaccttttaaatgatgcctctcttatatctgtaaggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaa

SEQ ID NO: 6396 - DNA, 960 bp, Homo sapiens
ccccttcccggaagtgagtccccgagaagcgtgcggcgaggacagaggtgggctcaacaccaagaggccaccaatgaaaacgtgactttttcacattccccgccccttccgtgtgcacgctccccacgaggggctggttcctgaaaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattcaaa

SEQ ID NO: 6397 - DNA, 582 bp, Homo sapiens
aggatgtacagaggatccccaaccgcctgcgaaacccaagccgccgcgtaggagcgtgcgttcgggccctcttctcccacctgttcggccagcctccacgatccagctgccaaccatctagcctaccctgatctctgagcaggggtcgtcgtcattttactccagaggagactgaagccaaaagactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttg

SEQ ID NO: 6398 - DNA, 1038 bp, Homo sapiens
cattttttttcttttttctttttttttgagatggagttttgctcttattgcccaggagtttgagaccatgctgagcaacatggaaaaaccttgtctctattaaagaatcaaaaaaattagctgagtggtgatgcacacctgtagtcccagctactctggccagggagggactgagggggaaggattgcttgatccctaaagatggaggctacagtgagcctgggcaacaaagcaagacaccctcaaaaaaaaaaaaaaaaaaacaagcatctgtcttcaagcttagagtctcccacgggagacagacacattaaacaggctaaatggtgcagtctggtcagtgctatttataatttaggaaccttacatattatatccctactctaacctgttaatgttctatagactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattga

SEQ ID NO: 6399 - DNA, 922 bp, Homo sapiens
ctcaaagttcaaagtcctcgatacgcctgaggcgcctcaggcctcgtggctgccagcatttttctgctttaagatcctttccatgacttccttgtttaggccagcctccacgatccagctgccaaccatctagcctaccctgatctctgagcaggggtcgtcgtcattttactccagaggagactgaagccaaaagactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattca

SEQ ID NO: 6400 - DNA, 2631 bp, Homo sapiens
atctctcggcttccgttgagcaccaagcaagatggcagcttccgagacggttaggctacggcttcaatttgattacccgccgccagctaccccgcactgtacggccttctggcttctggtcgacttgaacagatgccgagtcgtcacagatctcattagtctcatccgccagcgcttcggcttcagttctggggccttcctaggcctctacctggagggggggctcttgccccccgccgagagcgcgcgccttgtgagagacaacgactgcctcagagttaaattagaagagagaggagttgctgagaattctgtagtcatcagtaatggtgacattaatttatctcttagaaaagcaaagaagcgggcatttcagttagaggagggtgaagaaactgaaccagattgcaaatattcaaagaagcattggaagagtcgagagaacaataacaataatgagaaggtcttggatctggaaccaaaagctgtcacagatcagactgtcagcaaaaaaaacaagagaaaaaataaagcaacctgtggcacagtgggtgatgataacgaagaggccaaaagaaaatcaccaaagaaaaaggagaaatgtgaatataaaaaaaaggctaagaatcccaagtctccgaaagtacaggcagtgaaagactgggccaatcagagatgtagttctccaaaaggttctgctagaaacagccttgttaaagccaaaaggaaaggtagtgtaagcgtttgctcaaaagagagtcccagttcctcctcggagtctgaatcttgtgatgaatctatcagtgatggtcccagcaaagtcactttggaggccagaaattcctcagagaaattaccaactgagttatcaaaggaagaaccctctaccaaaaatacaactgcagacaaactggctataaaacttggctttagccttacccccagcaagggcaagacctctggaacaacatcttccagttcagactctagtgcagagtcagacgaccaatgcttgatgtcatcgagcaccccggagtgtgctgcgggtttcttaaagacagtaggcctttttgcaggaagaggtcgtccaggcccagggctgtcatcacagactgcaggtgctgctggatggaggcgttctggctcaaatggtggtggacaggctcctggtgcttctcccagtgtgtctctccctgctagtttaggaagaggatggggtagagaagagaaccttttttcttggaagggagctaagggacggggcatgcgggggagaggtcgaggacgagggcatcctgtttcctgtgttgtaaatagaagcactgacaaccagaggcaacagcaattaaatgacgtggtaaaaaattcatctactattatccagaatccagtagagacacccaagaaggactatagtctgttaccactgttagcagctgcccctcaagttggagaaaagattgcatttaagcttttggagctaacatccagttactctcctgatgtctctgactacaaggaaggaagaatattaagccacaatccagagacccagcaagtagatatagaaattctttcatccttacctgccttgagagaacctgggaaatttgatttagtttatcacaatgaaaatggagccgaggtagtggagtacgctgtgacacaggagagcaagatcactgtattttggaaagagttgattgacccaagactgattattgaatctccaagtaacacatcaagtacagaacctgcctgagtatgacctctccaccttatagtttatgaatgtcttgtttgtgaaagtgactataacccaaacttttttttttttttaaagaggatttggaagttgtatggatttttttgttatcttcactttactgcataggaaacaatctacctcatcatttaaaatgacatgggtgtcggttttgtagatctttggtttttttgtcaggtttaatttcagttaacaaaatgtaaaacatgacattccctgcagatattgttgtataccagtatggtttcttctctttctttaaatgtttttggccatcaagtagcagtcgtcagtaggagtttataataccaagaatgtgctgcgtatcttgtctcaataagttttaagtaacatttaaaaatattaaagcatgttatttgacctaattttttagcatttgagttgttccattaaatggagcatcttgtaaatttcaagtattttatacttgcaattgttaagagttaacaggtagttggatttgtcgcagacaatgagttaaggaatcctttcacgtttttcccaactttaaaattaaggattctcaggtccctgtgtagagcagtgaaaataagatgtgcgtatgtgtgtgtatgcctggagaattggtgtttcacttcagtgagaggattggctgtgagcttcagaccaggaaatgtgtcatcttgccaggcacctggctgagtgtgctggagtgaggatcttgaacagaaacttccttttctgttattattcactacgaagctaaaatggccaaatatataccgtgaaaattggtttcatttaacaaaagatcagatccctccttcagctgtacacatttttaaataaaatcatattgaact

SEQ ID NO: 6401 - DNA, 1397 bp, Homo sapiens
aggatgtgtagggggcggggcccggcggaagcgtatataaggccgggctcggggacgcccccccctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaa

SEQ ID NO: 6402 - DNA, 1543 bp, Homo sapiens
ctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctga

SEQ ID NO: 6403 - DNA, 3025 bp, Homo sapiens
actcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcctgagaccttcctaggggctgtggctgtttccggggaggccgggaggggcagctgtgagccctgtggaggacgttgggagtaacgctgctttgctttggcaggttgaaggggcccggccaggactcggggaagggtggcctgagagcagcgatgacctctggggtcactgtcccaggagggacttcacctggaacaagagctggaggcagccgcttgcccaggaggcttgtcccctgaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccag

SEQ ID NO: 6404 - DNA, 1333 bp, Homo sapiens
ctcactcgcgcgttaggaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttatgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaa

SEQ ID NO: 6405 - DNA, 3228 bp, Homo sapiens
gggccgtgctgcttatggcggcgctggagagggggcgctgagctgttgggatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctg

SEQ ID NO: 6406 - DNA, 4006 bp, Homo sapiens
ctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagca

SEQ ID NO: 6407 - DNA, 4076 bp, Homo sapiens
gcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagttgtgtgcgctgttcctcacaacttagagagtaaatctccagctgccccgggtcagagtccaacagggagtgtatgctacgaacgtaatggggaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacact

SEQ ID NO: 6408 - DNA, 3774 bp, Homo sapiens
gagagaagcgagatttattcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagctgtttgagatggagaacgtttttactgtgtcatcagatcctcatccctctcctgcagcccctccttcactttctttacccttatcttcatcttctacctcatctgggactaaaaaacaaaagaggaccccaacttatcagagatctatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaa

SEQ ID NO: 6409 - DNA, 4167 bp, Homo sapiens
cagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagctgtttgagatggagaacgtttttactgtgtcatcagatcctcatccctctcctgcagcccctccttcactttctttacccttatcttcatcttctacctcatctgggactaaaaaacaaaagaggaccccaacttatcagagatctatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagttgtgtgcgctgttcctcacaacttagagagtaaatctccagctgccccgggtcagagtccaacagggagtgtatgctacgaacgtaatggggaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacacta

SEQ ID NO: 6410 - DNA, 626 bp, Homo sapiens
attggatgaatcatctctttgctcttatttcaaccttttaattactgatccaccctctttgattacctgacacaacaggaatatctttcgtaacttgaaagtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgagctttgatccaaaccttctccacaacaatggacataatgggtaccctaatggtacttcagcagcactgcgtgaaactggggttattgaaaaactgttaacctcttacggatttattcagtgttcagaacgtcaa

SEQ ID NO: 6411 - DNA, 503 bp, Homo sapiens
attcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatatgtatatattctttttctttttaaaacagatgagctttgatccaaacctt

SEQ ID NO: 6412 - DNA, 3459 bp, Homo sapiens
gcgcccggagcccgcaactctcgcgagagaagcgagatttattcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagatgatgttgaatttgaagtatcatcggaccgacggactgggaaacccattgctgttaaactggtgaagataaaacaagaaatcctccctgaagaacgaatgaatggacaagaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaa

SEQ ID NO: 6413 - DNA, 601 bp, Homo sapiens
agatgtgggaactattgagcttacttttcatccctagcaaaaaccccagagccagtgaataaataacttggcagactagctcatgatagcataatggtcaatatggagaaatgttggatggatagcagttagtaagagactgattttagagaagtctccaggtgtatgctgccagatgctatcctcgccctgcttttttcagagacctaatgagtagttctgtgagtacctatgtgctacgtaagcacttattttaggctttttacgtgcagcaactcatttaaccatctcaacaactctgtgagacaggtgttaagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcct

SEQ ID NO: 6414 - DNA, 2667 bp, Homo sapiens
tacgtaccgggccgtgctgcttatggcggcgctggagagggggcgctgagctgttgggatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggagatgatgttgaatttgaagtatcatcggaccgacggactgggaaacccattgctgttaaactggtgaagataaaacaagaaatcctccctgaagaacgaatgaatggacaagttgtgtgcgctgttcctcacaacttagagagtaaatctccagctgccccgggtcagagtccaacagggagtgtatgctacgaacgtaatggggaagtgttttatctgacttacacccctgaagatgtcgaagggaacgttcagctggaaactggagataaaataaactttgtaattgataacaataaacatactggtgctgtaagtgctcgcaacattatgctgttgaaaaagaaacaagcccgctgtcagggagtagtttgtgccatgaaggaggcatttggctttattgaaagaggtgatgttgtaaaagagatattctttcactatagtgaatttaagggtgacttagaaaccttacagcctggcgatgatgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatgggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggaggctgaggatggcattattgcttatgatgactgtggggtgaaactgactattgcttttcaagccaaggatgtggaaggatctacttctcctcaaataggagataaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacagtgagttctctggtgatgttgatagcctggaactgggggacatggtcgagtatagcttgtccaaaggcaaaggcaacaaagtcagtgcagaaaaagtgaacaaaacacactcagtgaatggcattactgaggaagctgatcccaccatttactctggcaaagtaattcgccccctgaggagtgttgatccaacacagactgagtaccaaggaatgattgagattgtggaggagggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctgtgagggccccaaggctgttgcagctcctcgacctgatcggttggtcaatcgcttgaagaatatcactctggatgatgccagtgctcctcgcctaatggttcttcgtcagccaaggggaccagataactcaatggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctg

SEQ ID NO: 6415 - DNA, 1796 bp, Homo sapiens
gcgaggagcccaagagagagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaa

SEQ ID NO: 6416 - DNA, 1713 bp, Homo sapiens
gagcccaagagagagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaatgctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagaggacagaa

SEQ ID NO: 6417 - DNA, 526 bp, Homo sapiens
ccacaccagctgtcccactcaccatggagaagatcctgatcctcctgcttgtcgccctctctgtggcctatgcagctcctggcccccgggggatcattatcaacctggagaacggtgagctctgcatgaatagtgcccagtgtaagagcaattgctgccagcattcaagtgcgctgggcctggcccgctgcacatccatggccagcgagaacagcgagtgctctgtcaagacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaaccttt

SEQ ID NO: 6418 - DNA, 416 bp, Homo sapiens
ctgtctcccgccacccacaccagctgtcccactcaccatggagaagatcctgatcctcctgcttgtcgccctctctgtggcctatgcagctcctggcccccgggggatcattatcaacctgacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaacctt

SEQ ID NO: 6419 - DNA, 1569 bp, Homo sapiens
aggaaaaagtgctgcaaaggatataaatttgttcttggacaatgcatcccagaagattacgacgtttgtgccgaggctccctgtgaacagcagtgcacggacaactttggccgagtgctgtgtacttgttatccgggataccgatatgaccgggagagacaccggaagcgggagaagccatactgtctggatattgatgagtgtgccagcagcaatgggacgctgtgtgcccacatctgcatcaataccttgggcagctaccgctgcgagtgccgggaaggctacatccgggaagatgatgggaagacatgtaccaggggagacaaatatcccaatgacactggccatgagaagtctgagaacatggtgaaagccggaacttgctgtgccacatgcaaggagttctaccagatgaagcagaccgtgctgcagctgaagcaaaagattgctctgctccccaacaatgcagctgacctgggcaagtatatcactggtgacaaggtgctggcctcaaacacctaccttccaggacctcctggcctgcctgggggccagggccctcccgggtccaccaggggcaccaggaagagatggttctaagggggagagaggagcgcctgggcccagagggtctccaggaccccctggttctttcgacttcctgctacttatgctggctgacatccgcaatgacatcactgagctgcaggaaaaggtgttcgggcaccggactcactcttcagcagaggagttccctttacctcaggaatttcccagctacccagaagccatggacctgggctctggagatgaccatccaagaagaactgagacaagagacttgagagcccccagagacttctacccatagcacatcccaacaccgtcacgccaaaggaagagaaagatcaactcacctgcagttaaaccatctaaagagaagaaagaccactggagacctagaaaacatacatttttctcttctcttctcctgacgtctctccactcctcttcttccaaatacgatgctattttcagagtcccctcctaggcctgcagacatgagggagtgaatgattgatttacctgcttctcactaagagtccattggggtggtttgcattgtaacttttcttttacatcctatttttccaggaactttggatttaagtactctcacagtgtcttaaatcataaattcttgaagttaaatttggcagagtatcaaaagggggaaaatgacaaagtgagctctaagaaaatgtgaggctacttctaagatgtgtgttcacaatagaccataactcctctagtatcaaaattggggctcttcagttaaaaaggggtggggaggacaaacgtgtcgatgtgctttggtggagaattttttccttgtgcttctagtagactttaaatattgtatccctttgtcaaaccttgtttcccaaattcaattaaagagaggagagaattgaatggcgtttagagaagatagaaaagaatcacagtcatatatttactgttatatagattgccacattctaaaattcaaatacggtgcttaaggtt

SEQ ID NO: 6420 - DNA, 1919 bp, Homo sapiens
atggtgccgccgcctccgagccggggaggagctgccaggggccagctgggcaggagcctgggtccgctgctgctgctcctggcgttgggacacacgtggacctacagagaggagccggaggacggcgacagagaaatctgctcagagagcaaaatcgcgacgactaaatacccgtgtctgaagtcttcaggcgagctcaccacatgctacaggaaaaagtgctgcaaaggatataaatttgttcttggacaatgcatcccagaagattacgacgtttgtgccgaggctccctgtgaacagcagtgcacggacaactttggccgagtgctgtgtacttgttatccgggataccgatatgaccgggagagacaccggaagcgggagaagccatactgtctggatattgatgagtgtgccagcagcaatgggacgctgtgtgcccacatctgcatcaataccttgggcagctaccgctgcgagtgccgggaaggctacatccgggaagatgatgggaagacatgtaccaggggagacaaatatcccaatgacactggccatgagaagtctgagaacatggtgaaagccggaacttgctgtgccacatgcaaggagttctaccagatgaagcagaccgtgctgcagctgaagcaaaagattgctctgctccccaacaatgcagctgacctgggcaagtatatcactggtgacaaggtgctggcctcaaacacctaccttccaggacctcctggcctgcctgggggccagggccctcccggctcaccaggaccaaagggaagcccaggcttccccggtatgccaggccctcctgggcagcccggcccacggggctcaatgggacccatgggaccatctcctgatctgtcccacattaagcaaggccggaggggccctgtgggtccaccaggggcaccaggaagagatggttctaagggggagagaggagcgcctgggcccagagggtctccaggaccccctggttctttcgacttcctgctacttatgctggctgacatccgcaatgacatcactgagctgcaggaaaaggtgttcgggcaccggactcactcttcagcagaggagttccctttacctcaggaatttcccagctacccagaagccatggacctgggctctggagatgaccatccaagaagaactgagacaagagacttgagagcccccagagacttctacccatagcacatcccaacaccgtcacgccaaaggaagagaaagatcaactcacctgcagttaaaccatctaaagagaagaaagaccactggagacctagaaaacatacatttttctcttctcttctcctgacgtctctccactcctcttcttccaaatacgatgctattttcagagtcccctcctaggcctgcagacatgagggagtgaatgattgatttacctgcttctcactaagagtccattggggtggtttgcattgtaacttttcttttacatcctatttttccaggaactttggatttaagtactctcacagtgtcttaaatcataaattcttgaagttaaatttggcagagtatcaaaagggggaaaatgacaaagtgagctctaagaaaatgtgaggctacttctaagatgtgtgttcacaatagaccataactcctctagtatcaaaattggggctcttcagttaaaaaggggtggggaggacaaacgtgtcgatgtgctttggtggagaattttttccttgtgcttctagtagactttaaatattgtatccctttgtcaaaccttgtttcccaaattcaattaaagagaggagagaattgaatggcgtttagagaagatagaaaagaatcacagtcatatatttactgttatatagattgccacattctaaaattcaaatacggtgcttaaggtt

SEQ ID NO: 6421 - DNA, 815 bp, Homo sapiens
agaaggtttaaggccggaaagggaaatgaaggggcccggcgctaaccctctaaggacctgttttgcttctgtttaaaccaaatgggcagtctgtcattacacacaccctgggtcttcatatgtggccgccaggtaggagcatcacagtcaagctacgggagaaaacagtttccaggaaactggaaatgaacggcccgagtgctttccaggggctcatctgtgggaagtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggtacttgttcagattacccaaaaggagatgcttctactggatggaattcagtttctcgcatcattattgaagaactaccaaactacctcttt

SEQ ID NO: 6422 - DNA, 1271 bp, Homo sapiens
gggagggagagaggcgcgcgggtgaaaggcgcattgatgcagcctgcggcggcctcggagcgcggcggagccagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcagctccggcagagggaggtggtggacctgtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggtacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaacaaccttaata

SEQ ID NO: 6423 - DNA, 1198 bp, Homo sapiens
agaaggtttaaggccggaaagggaaatgaaggggcccggcgctaaccctctaaggacctgttttgcttctgtttaaaccaaatgggcagtctgtcattacacacaccctgggtcttcatatgtggccgccaggtaggagcatcacagtcaagctacgggagaaaacagtttccaggaaactggaaatgaacggcccgagtgctttccaggggctcatctgtgggaagtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggtacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaacaa

SEQ ID NO: 6424 - DNA, 6380 bp, Homo sapiens
atggaactatctcctgagtgctgcaagttgtaacgggcaccgctgagcctgtttccctttggagcacttcttatctagaagcagtgtttagtttcttccaaactgggccacttcgtccacctactctgttctgagtaaggaaacagcctccaagcatcagcagagcccagatgagcacgggccgcggagccgcttagcagtctcccgggacccagctccggaggagccgcaagcatgcaccctgggttgtggctgctcctggttacgttgtgcctgaccgaggaactggcagcagcgggagagaagtcttatggaaagccatgtgggggccaggactgcagtgggagctgtcagtgttttcctgagaaaggagcgagaggacgacctggaccaattggaattcaaggcccaacaggtcctcaaggattcactggctctactggtttatcgggattgaaaggagaaaggggtttcccaggccttctgggaccttatggaccaaaaggagataagggtcccatgggagttcctggctttcttggcatcaatgggattccgggccaccctggacaaccaggccccagaggcccacctggtctggatggctgtaatggaactcaaggagctgttggatttccaggccctgatggctatcctgggcttctcggaccacccgggcttcctggtcagaaaggatcaaaaggtgaccctgtccttgctccaggtagtttcaaaggaatgaagggggatcctgggctgcctggactggatggaatcactggcccacaaggagcacccggatttcctggagctgtaggacctgcaggaccaccaggattacaaggtcctccagggcctcctggtcctcttggtcctgatgggaatatggggctaggttttcaaggagagaaaggagtcaagggggatgttggcctccctggcccagcaggacctccaccatctactggagagctggaattcatgggattccccaaagggaagaaaggatccaagggtgaaccagggcctaagggttttccaggcataagtggccctccaggcttcccgggccttggaactactggagaaaagggagaaaagggagaaaagggaatccctggtttgccaggacctaggggtcccatgggttcagaaggagtccaaggccctccagggcaacagggcaagaaagggaccctgggatttcctgggcttaatggattccaaggaattgagggtcaaaagggtgacattggcctgccaggcccagatgttttcatcgatatagatggtgctgtgatctcaggtaatcctggagatcctggtgtacctggcctcccaggccttaaaggagatgaaggcatccaaggcctacgtggcccttctggtgtccctggattgccagcattatcaggtgtcccaggagccctagggcctcagggatttccagggctgaagggggaccaaggaaacccaggccgtaccacaattggagcagctggcctccctggcagagatggtttgccaggcccaccaggtccaccaggcccacctagtccagaatttgagactgaaactctacacaacaaagagtcagggttccctggtctccgaggagaacaaggtccaaaaggaaacctaggcctcaaaggaataaaaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccaggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccgggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggaatcaccctgccctgtattattcctgggtcatacggtccatcaggatttccaggcactcccggattcccaggccctaaagggtctcgaggcctccctgggaccccaggccagcctgggtcaagtggaagtaaaggagagccagggagtccaggattggttcatcttcctgaattaccaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggagacagaggcaatccggggccagtcggaatacctagtccaagacgtccaatgtcaaacctttggctcaaaggagacaaaggctctcaaggctcagccggatccaatggatttcctgggccaagaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtggttcacaaggtatcagagggtcgcctggactcccaggagcatctggtctcccaggcctgaaaggagacaacggccagacagttgaaatttccggtagcccaggacccaagggacagcctggcgaatctggttttaaaggcacaaaaggaagagatggactaataggcaatataggcttccctggaaacaaaggtgaagatggaaaagttggtgtttctggagatgttggccttcctggagctccaggatttccaggagttgccggcatgagaggagaaccaggacttccaggttcttctggtcaccaaggggcaattgggcctctaggatcccccggattaataggacccaaaggcttccctggatttcctggtttacatggactgaatgggcttccgggcaccaagggtacccatggcactccaggacctagtatcaccggtgtgcctgggcctgctggtctccctggacccaaaggagaaaaaggatatccaggaattggcatcggagctccagggaagccgggcctgagagggcaaaaaggtgatcgaggtttcccaggtctccagggccctgctggtctccccggtgccccaggcatctccttgccctcactcatagcaggacagcctggtgaccccgggcgaccaggcctagatggagaacgaggccgcccaggccccgctggacccccaggtccccctgggccatcctcgaatcaaggcgacaccggagaccctggcttccctggaattccaggtttttctggcctccctggagagctaggactgaaaggcatgagaggtgagcctggcttcatggggactccaggcaaggttgggccacctggagacccaggatttcccggaatgaaggggaaggcagggccaagaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggctccaaaggtttacctggcatccccggtaaagatggccccagtgggctcccaggcccacctggggctcttggtgatcctggtctgcctggactgcaaggccctccaggatttgaaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatgcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacc

SEQ ID NO: 6425 - DNA, 4238 bp, Homo sapiens
tccttgccctccgctctcactctggctgggagcagaaggcagcctcggtctctgggcggcggcggcggcccactctgccctggccgcgctgtgtggtgaccgcaggccccagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcttgctgtgaatgcaagtgcggccccatcgacctcctgttcgtgctggacagctcagagagcattggcctgcagaacttcgagattgccaaggacttcgtcgtcaaggtcatcgaccggctgagccgggacgagctggtcaagttcgagccagggcagtcgtacgcgggtgtggtgcagtacagccacagccagatgcaggagcacgtgagcctgcgcagccccagcatccggaacgtgcaggagctcaaggaagccatcaagagcctgcagtggatggcgggcggcaccttcacgggggaggccctgcagtacacgcgggaccagctgctgccgcccagcccgaacaaccgcatcgccctggtcatcactgacgggcgctcagacactcagagggacaccacaccgctcaacgtgctctgcagccccggcatccaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcatagacaagaagtgtccagattacacctgccccatcacgttctcctccccggctgacatcaccatcctgctggacggctccgccagcgtgggcagccacaactttgacaccaccaagcgcttcgccaagcgcctggccgagcgcttcctcacagcgggcaggacggaccccgcccacgacgtgcgggtggcggtggtgcagtacagcggcacgggccagcagcgcccagagcgggcgtcgctgcagttcctgcagaactacacggccctggccagtgccgtcgatgccatggactttatcaacgacgccaccgacgtcaacgatgccctgggctatgtgacccgcttctaccgcgaggcctcgtccggcgctgccaagaagaggctgctgctcttctcagatggcaactcgcagggcgccacgcccgctgccatcgagaaggccgtgcaggaagcccagcgggcaggcatcgagatcttcgtggtggtcgtgggccgccaggtgaatgagccccacatccgcgtcctggtcaccggcaagacggccgagtacgacgtggcctacggcgagagccacctgttccgtgtccccagctaccaggccctgctccgcggtgtcttccaccagacagtctccaggaaggtggcgctgggctagcccaccctgcacgccggcaccaaaccctgtcctcccacccctccccactcatcactaaacagagtaaaatgtgatgcgaattttcccgaccaacctgattcgctagattttttttaaggaaaagcttggaaagccaggacacaacgctgctgcctgctttgtgcagggtcctccggggctcagccctgagttggcatcacctgcgcagggccctctggggctcagccctgagctagtgtcacctgcacagggccctctgaggctcagccctgagctggcgtcacctgtgcagggccctctggggctcagccctgagctggcctcacctgggttccccaccccgggctctcctgccctgccctcctgcccgccctccctcctgcctgcgcagctccttccctaggcacctctgtgctgcatcccaccagcctgagcaagacgccctctcggggcctgtgccgcactagcctccctctcctctgtccccatagctggtttttcccaccaatcctcacctaacagttactttacaattaaactcaaagcaagctcttctcctcagcttggggcagccattggcctctgtctcgttttgggaaaccaaggtcaggaggccgttgcagacataaatctcggcgactcggccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctctc

SEQ ID NO: 6426 - DNA, 2163 bp, Homo sapiens
gcagaaggcagcctcggtctctgggcggcggcggcggcccactctgccctggccgcgctgtgtggtgaccgcaggccccagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgtctcctgagggtcctgctggtgaccggcctggaccttggccctacagccctggaggccgctgctgaccagcactgaccccgacctcagagagtactcgcaggggcgctggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttccaaataaaggttttcactcctc

SEQ ID NO: 6427 - DNA, 2004 bp, Homo sapiens
agaaggcagcctcggtctctgggcggcggcggcggcccactctgccctggccgcgctgtgtggtgaccgcaggccccagacatgagggcggcccgtgctctgctgcccctgctgctgcaggcctgctggacagccgcgcaggatgagccggagaccccgagggccgtggccttccaggactgccccgtggacctgttctttgtgctggacacctctgagagcgtggccctgaggctgaagccctacggggccctcgtggacaaagtcaagtccttcaccaagcgcttcatcgacaacctgagggacaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttgggaagggcacctacaccgactgcgctatcaagaaggggctggagcagctcctcgtggggggctcccacctgaaggagaataagtacctgattgtggtgaccgacgggcaccccctggagggctacaaggaaccctgtggggggctggaggatgctgtgaacgaggccaagcacctgggcgtcaaagtcttctcggtggccatcacacccgaccacctggagccgcgtctgagcatcatcgccacggaccacacgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccggggctccggggcgaccccggctttgagggagaacgaggcaagccggggctcccaggagagaagggagaagccggagatcctggaagacccggggacctcggacctgttgggtaccagggaatgaagggagaaaaagggagccgtggggagaagggctccaggggacccaagggctacaagggagagaagggcaagcgtggcatcgacggggtggacggcgtgaagggggagatggggtacccaggcctgccaggctgcaagggctcgcccgggtttgacggcattcaaggaccccctggccccaagggagaccccggtgcctttggactgaaaggagaaaagggcgagcctggagctgacggggaggcggggagaccagggagctcgggaccatctggagacgagggccagccgggagagcctgggccccccggagagaaaggagaggcgggcgacgaggggaacccaggacctgacggtgcccccggggagcggggtggccctggagagagaggaccacgggggaccccaggcacgcggggaccaagaggagaccctggtgaagctggcccgcagggtgatcagggaagagaaggccccgttggtgtccctggagacccgggcgaggctggccctatcggacctaaaggctaccgaggcgatgagggtcccccagggtccgagggtgccagaggagccccaggacctgccggaccccctggagacccggggctgatgggtgaaaggggagaagacggccccgctggaaatggcaccgagggcttccccggcttccccgggtatccgggcaacaggggcgctcccgggataaacggcacgaagggctaccccggcctcaagggggacgagggagaagccggggaccccggagacgataacaacgacattgcaccccgaggagtcaaaggagcaaaggggtaccggggtcccgagggcccccagggacccccaggacaccaaggaccgcctgggccggacgaatgcgagattttggacatcatcatgaaaatgtgctcctgcagaatgcaagtgcggccccatcgacctcctgttcgtgctggacagctcagagagcattggcctgcagaacttcgagagccacctgttccgtgtccccagctacca

SEQ ID NO: 6428 - DNA, 3461 bp, Homo sapiens
cggccgcggttccctccctgctgcttactcggcgcccgcgcctcgggccgtcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacagtggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccat

SEQ ID NO: 6429 - DNA, 3446 bp, Homo sapiens
gcttactcggcgcccgcgcctcgggccgtcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacagtggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacaggtttggacggagctgttttgtgctgaaaggttttctcggggtccgtggtgtcccccaaaggtgccaccgtgcgggtctcctagctccctgccagcttcctgtccctgtgctcactgcccccacgcctcctgccaaggccgagccacacacccgctccacctgcatttcctctaccgactcgccagcccaaatgccgctcttcactctggcctcgctgagcggctgcccgaggaggagctctaggccgacgcccaccgcaggccttacagtcttctctggacgctcccttgcagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcggggtcagcggggctacagtccttccaggggctctggggcagctcccagcctcttcccatgctggtggccaccgtgtcccttgctgcggctgcatcttccagtctctcctccgtcttcctgtggccgctctctttataagaaccctggtcattgaatttaaggcccaccccaagtccagaatgacctcgcaagacccttaactcactccc

SEQ ID NO: 6430 - DNA, 3153 bp, Homo sapiens
gcttactcggcgcccgcgcctcgggccgtcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacagtggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcggggtcagcggggctacagtccttccaggggctctggggcagctcccagcctcttcccatgctggtggccaccgtgtcccttgctgcggctgcatcttccagtctctcctccgtcttcctgtggccgctctctttataagaaccctggtcattgaatttaaggcccaccccaagtccagaatgacctcgcaagacccttaactcactccc

SEQ ID NO: 6431 - DNA, 3101 bp, Homo sapiens
gacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacagtggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcggggtcagcggggctacagtccttccaggggctctggggcagctcccagcctcttcccatgctggtggccaccgtgtcccttgctgcggctgcatcttccagtctctcctccgtcttcctgtggccgctctctttataagaaccctggtcattgaatttaaggcccaccccaagtccagaatgacctcgcaagacccttaactcactcccgtc

SEQ ID NO: 6432 - DNA, 3430 bp, Homo sapiens
ctgggggtgtctgagcgacccccacccctgttgcaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacagtggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacaggtttggacggagctgttttgtgctgaaaggttttctcggggtccgtggtgtcccccaaaggtgccaccgtgcgggtctcctagctccctgccagcttcctgtccctgtgctcactgcccccacgcctcctgccaaggccgagccacacacccgctccacctgcatttcctctaccgactcgccagcccaaatgccgctcttcactctggcctcgctgagcggctgcccgaggaggagctctaggccgacgcccaccgcaggccttacagtcttctctggacgctcccttgcagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcggggtcagcggggctacagtccttccaggggctctggggcagctcccagcctcttcccatgctggtggccaccgtgtcccttgctgcggctgcatcttccagtctctcctccgtcttcctgtggccgctctctttataagaaccctggtcattgaatttaaggcccaccccaagtccagaatgacctcgcaagacccttaactcactcccgtc

SEQ ID NO: 6433 - DNA, 919 bp, Homo sapiens
ggcggctccccagggcggcgggacccgggctgacagcgacccgcagcccctgccgggccgcccacacccgccctgggactccgccggggcgctggtggaaccgctgggcctgggtctccactgctggcaaccgaacggatcggccctctgtggagccgcaggtgtgcgggcgagcggcgcccatccgggctgtgccagcagaaccccggtgcccgcgcctaggacgcccctggagaagggaccttccctttggggtcggaacccagaaaggaggggcctgcgatccgcggagctccttgttcttgggataacacagctctggcttggaggcccccttgcacttcgactctggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggccc

SEQ ID NO: 6434 - DNA, 5705 bp, Homo sapiens
agagaagagtgtccagctcctccagaggctgcccgcccgccgctccttccctgcccacctactatgaggagcagctcctcccacctgcccataaaagccaagtgcatgttaccagcagcggatcacagcccttccccgatcctctccgtgggagccagcgagcctctctccctgatcttacgtgctcaagggagctcacacgttcaccaactcacccttgaagtcatctcaagaacaaaagacaactgaaagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaagaaataccattagccagtttacgaggggaacaaggtccccgtggagagcctggcccaagaggaccacctgggccccctggtttgccaggtcatgggatacctggaattaaaggaaaaccagggccacagggatatccaggagttggaaagccaggtatgcctggaatgccagggaagccaggagccatgggcatgcctggggcaaaaggagaaattggacagaaaggggaaattgggcctatggggatcccaggaccacaaggacctccagggcctcatggacttcctggcattgggaagccaggtgggccagggttaccagggcaaccaggaccaaagggtgatcgaggacccaaaggactaccaggacctcaaggccttcggggtcctaaaggagacaagggcttcgggatgccaggtgcgccaggtgtaaaggggcctccagggatgcacggccctcccggccctgttggactgccaggagtgggcaaaccaggagtgacaggcttccctgggccccagggccccctgggaaagccaggggctccaggagaacctgggccacaaggccctattggggtaccgggggttcaaggacctcctgggatacccggaattggaaagccaggccaggatgggatcccaggccagccaggatttccaggtggcaaaggggagcaaggactgccagggctaccaggacccccaggccttccagggattgggaaaccaggcttcccaggacccaaaggtgaccggggcatgggaggtgttcctggggctcttggaccaagaggggagaaaggaccaataggtgccccaggaatagggggtcctccaggagagccaggcctgcctggaatcccaggtcctatgggccctccaggtgctattggttttcctggacccaaaggagaaggtgggattgtagggccacaggggccaccaggtcccaagggtgagccagggcttcaaggcttcccaggaaagccaggtttccttggtgaagtagggcctcctggcatgaggggtttgccaggtcccatagggcccaagggggaagctgggcaaaaaggtgtaccaggactccctggtgttccagggcttctcggacctaagggagagccaggaatcccaggggatcagggtttacagggccccccaggtatcccagggattgggggccctagtggccccattggaccacctgggattccaggccccaaaggggagccgggcctcccagggccccctgggttccctggtatagggaaacccggagtggcaggacttcatggccccccagggaagcctggtgcccttggtcctcaaggccagcctggccttccaggacccccaggccctccaggacctccaggacccccagctgtgatgccccctacaccaccaccccagggagagtatctgccagatatggggctgggaattgatggcgtgaaacccccccatgcctacggggctaagaaaggcaagaatggagggccagcctatgagatgcctgcatttaccgccgagctaaccgcacctttcccaccggtgggggccccagtgaagtttaacaaactgctgtataacggcagacagaactacaacccgcagacaggcatcttcacctgtgaggtccctggtgtctactactttgcataccacgttcactgcaaggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaacaaaaaacaaagaaaagaaagagattttatagaagaaaatgacacaccaaaaaatccaaatgaaaaacataattgcttcaaaacacttacacagttggaaagttatatgtaagtgaaaatttggaccattgtgtacaaataaaaactaagatgcatgtttaatactccacacagcagcctgtaattgcgaatgatgggatagagttatgtatcaagtactgacacttggttgtacccactggaatcatattagctgttttatgttatatgcttccacagtaacctgcttattcagatcagtcaaaatatatcagtatgaaagatcatagctaatgaaaggcactcactcatattgtttactttaaaatatttataaatatgccttaaagaaatacaaatgataacaattacataccgtatttacttgcttaatttcctctgtatttgtgtagatactttgacatggaatatatggtggggagacccgtagtgttaccgccccagtgggagggggccctggggaccctggtaatgctttagtcaaagggatatctctcttgtatcagaggctgtgtcttttagtaacaggagtcctcgtcagaattgcgtgtctgttgtctctaaaagaatgggtgaaccaatcggcctttgtgaatttattcagtgccttctctgtaccaagcactgggtaaggcacttttgtggagcattagacagtaaccctcaaggagctagagaaccggatgggagacatgagcagtaattaactcacttgttccccagagtttctatttgttttgattttctttttctgtgacttattttcctattttctttcctccatgtaattttcactatggcccaactaatataaacacctggaaattacaaggaaaaaaaattcttcctctaataactttccaaatttgtggaatatttatttgtaatagcagttatcagttatgcttatatagcattaaaaattctcctcctttgactacacacacaaccacagtgtggttctaatcatggagatatcagtaatttttagtaactgaattttgaggacatttctctgtttagcatgtatgcaaactgatatgtaatctgaggttccaaagtcaatttttttcttttttttttgagatggagtcttactctgtcacccaggctggagtgcagtagcacgatcttggcttactgcaacctctacctcctaggttcaagcaattgtcctgtctcagcctcccgagtactgggactactgtcttgcgccaccatgcctggctaatttttgtatatttagtaaagatgggttttcgccatgttggccaggctggtctcaaactcctggcctcaagtgatgcacctgcctcagccttccaaagtgctgggattacaggcatgagccaccgtgcccggccaaagtcagctttcaaaatccaagccataattggtgaggggggagtttcagaattacatagaaaaattaatatttgaaaaaataattctgaaatttcgaatttaaaaacagatgtgctgcttctgggtgtaggtagtaaaagtataggaaaagaactgtttccttagaagcggactgtggaagggctatgtagaatgtcaaagggcaacaagagcctgtgtttttaatgtcatcctgtactcggcacaaatcaaaggccaatacaagtctgaaaagcagaaataaatatttttccaggtttttgcttgggcacatactaactgctttgggcattctaatctggtctccaaacaccaaagacccatttcgagcctgctattagcctgctgctgactctatcacttggagcaataatgtggggttatggtggtggaatcttgtatatttttgtcaaaaataaaaccatgagttaaggggatagatatagatggaaaaatacacaaataaatacggtatgaaaacacatggaaatgtgtctttgtcaaatctgaatcattattaccatcacaaaaattcttctcttggccaatatctcatttccctatatagtatacaagcaccatttcttctcaatttttaagaagagaaattagtccattaccacaggggttcttgtcactactaattatacaacaatcttttcccaacaaaaagatgtcctccacaacctttgttttcaaagcagacagcatctatgtggccaaatatactttgggttgttcttgaggatactggttttgggctgatgactatggtgggcagcatggatccattgggctccttctgctaaacagccacattgaaatggtttaaaagcaagtcagatcaggtgatttgtaaaattgtatttatctgtacatgtatgggcttttaattcccaccaagaaagagagaaattatctttttagttaaaaccaaatttcacttttcaaaatatcttccaacttatttattggttgtcactcaattgcctatatatatatatatatgtgtgtgtgtgtgtgtgtgcgcgtgagcgcacgtgtgtgtatgcgtgcgcatgtgtgtgtatgtgtattatcagacataggtttctaacttttagatagaagaggagcaacatctatgccaaatactgtgcattctacaatggtgctaatctcagacctaaatgatactccatttaatttaaaaaagagttttaaataattatctatgtgcctgtatttcccttttgagtgctgcacaacatgttaacatattagtgtaaaagcagatgaaacaaccacgtgttctaaagtctagggattgtgctataatccctatttagttcaaaattaaccagaattcttccatgtgaaatggaccaaactcatattattgttatgtaaatacagagttttaatgcagtatgacatcccacaggggaaaagaatgtctgtagtgggtgactgttatcaaatattttatagaatacaatgaacggtgaacagactggtaacttgtttgagttcccatgacagatttgagacttgtcaatagcaaatcatttttgtatttaaatttttgtactgatttgaaaaacatcattaaatatctttaaaagtatgtttctca

SEQ ID NO: 6435 - DNA, 2596 bp, Homo sapiens
ccgatcctctccgtgggagccagcgagcctctctccctgatcttacgtgctcaagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaagaaataccattagccagtttacgaggggaacaaggtccccgtggagagcctggcccaagaggaccacctgggccccctggtttgccaggtcatgggatacctggaattaaaggaaaaccagggccacagggatatccaggagttggaaagccaggtatgcctggaatgccagggaagccaggagccatgggcatgcctggggcaaaaggagaaattggacagaaaggggaaattgggcctatggggatcccaggaccacaaggacctccagggcctcatggacttcctggcattgggaagccaggtgggccagggttaccagggcaaccaggaccaaagggtgatcgaggacccaaaggactaccaggacctcaaggccttcggggtcctaaaggagacaagggcttcgggatgccaggtgcgccaggtgtaaaggggcctccagggatgcacggccctcccggccctgttggactgccaggagtgggcaaaccaggagtgacaggcttccctgggccccagggccccctgggaaagccaggggctccaggagaacctgggccacaaggccctattggggtaccgggggttcaaggacctcctgggatacccggaattggaaagccaggccaggatgggatcccaggccagccaggatttccaggtggcaaaggggagcaaggactgccagggctaccaggacccccaggccttccagggattgggaaaccaggcttcccaggacccaaaggtgaccggggcatgggaggtgttcctggggctcttggaccaagaggggagaaaggaccaataggtgccccaggaatagggggtcctccaggagagccaggcctgcctggaatcccaggtcctatgggccctccaggtgctattggttttcctggacccaaaggagaaggtgggattgtagggccacaggggccaccaggtcccaagggtgagccagggcttcaaggcttcccaggaaagccaggtttccttggtgaagtagggcctcctggcatgaggggtttgccaggtcccatagggcccaagggggaagctgggcaaaaaggtgtaccaggactccctggtgttccagggcttctcggacctaagggagagccaggaatcccaggggatcagggtttacagggccccccaggtatcccagggattgggggccctagtggccccattggaccacctgggattccaggccccaaaggggagccgggcctcccagggccccctgggttccctggtatagggaaacccggagtggcaggacttcatggccccccagggaagcctggtgcccttggtcctcaaggccagcctggccttccaggacccccaggccctccaggacctccaggacccccagctgtgatgccccctacaccaccaccccagggagagtatctgccagatatggggctgggaattgatggcgtgaaacccccccatgcctacggggctaagaaaggcaagaatggagggccagcctatgagatgcctgcatttaccgccgagctaaccgcacctttcccaccggtgggggccccagtgaagtttaacaaactgctgtataacggcagacagaactacaacccgcagacaggcatcttcacctgtgaggtccctggtgtctactactttgcataccacgttcactgcaaggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaacaaaaaacaaagaaaagaaagagattttatagaagaaaatgacacaccaaaaaatccaaatgaaaaacataattgcttcaaaacacttacacagttggaaagttatatgtaagtgaaaatttggaccattgtgtacaaataaaaactaagatgcatgtttaatactc

SEQ ID NO: 6436 - DNA, 659 bp, Homo sapiens
agagaagagtgtccagctcctccagaggctgcccgcccgccgctccttccctgcccacctactatgaggagcagctcctcccacctgcccataaaagccaagtgcatgttaccagcagcggatcacagcccttccccgatcctctccgtgggagccagcgagcctctctccctgatcttacgtgctcaagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaagaaataccattagc

SEQ ID NO: 6437 - DNA, 2061 bp, Homo sapiens
atggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtggggtcccccggagacgctgggctgtccatcattggtccccgcggcccccctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccggctgctgcctctcctcaattcagtgcgactggctccacccccggtcataaaaaggcggacgttccagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccgggagagaaaggagaagccggggagaagggcaatccaggagcagaggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtga

SEQ ID NO: 6438 - DNA, 3134 bp, Homo sapiens
atatcctcccctgggctgaaggcactcttgtcctccaagcctcccctacagcagtgttcatgggcagctggagcagggctgcctacccattgctactcccaggagctcaggactggctccagacccctggcatctggagcagaagcaacatcaaagcagggattggccaactcccacccctaatgccaaacaggccaggcactgggagcactcagaggcgtgacgaatctcagcctgtctccggctagtgttccctggccagtccgctttgggccctgcctcacaatgacgggctcatcattcagcctcgctcatctgctcatcatttcaggactgctctgttactcggcaggctgcttggcccttcccagcctggatcagaagaagcgtggtggccacaaagcatgctgcctgctgacgcctcctccaccaccactgttcccaccaccattcttcagaggtggccgaagtccgcttctctccccagacatgaagaatctcatgctggaactggagacctcgcagtccccgtgcatgcaaggctcgctaggctcccctgggcctcccggcccccagggtccaccggggcttcctggcaagacaggaccaaagggagaaaagggggagcttggccgaccaggaaggaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcagggacagaaaggggatagtggagttatgggcccaccaggcaagcctgggccttctggtcaacctggccgtccggggcccccaggccccccacctgcaggacaacttataatgggacccaaaggggaaagaggatttcccgggcctccaggaagatgtctttgtggacccactatgaatgtgaataacccttcctacggggaatctgtgtatgggcccagttccccgcgagttcctgtgatttttgtggtcaacaaccaggaggagcttgagaggctgaacacccaaaacgccattgccttccgcagagaccagagatctctgtacttcaaggacagccttggctggctccccatccagctgacccctttctaccctgtggattacactgcagaccagcacggcacctgtggggatgggctcctgcagcctggggaggagtgtgacgacggtaacagcgatgtgggtgacgactgcatccgctgtcaccgtgcctactgtggagatggtcaccggcatgagggtgtggaggactgtgacggctctgactttggctacctgacatgcgagacctatctccctgggtcatatggagacctgcaatgcacccagtactgctacatcgactccacgccctgccgctacttcacctgagggccgtgaggagaaggtgggctgcgccccacagaactggcagcagcttctccactgtcatcaaactggccatgtcctggccccgtctccaccaacctttgtgtgacaaaaacaaggacaaattcctgctactaagacatgctgttaactcagtctgactggaagaatttaggaccactgcatcctgtcttaatccaaggtactggaaaaccttccacatgcccaacctgagacctgttccccatcgctaccatttggccaaacaaccggctacaatgctcttcctcttctggaatgttgctgacccaggccgtggacttggctgagcactgttagacacacacagacctgcaggctgttttagaatgttttgatctctttggggaatctggagtacaggcctctccgcccctgaccaccgaaacgtgcaggcattctcactcacactgggcagcccgctgtcgggtctctctaggcctatgaaccacaaagcagggaagtgggcacgttctctcggggtggctcacagctttgaacctgccaaaggacccctcgactggccacagcccagcccagcctgacgtggatgtggctgcccaggaaaagacttaactgtgaaaaagtactgagaacccacctgacccaggcttgccccaagcagaggctagagaagaggctcctcttctcagtgtttcccaaaggggcggctcttgtggtttcaaaatctctggcaccatcttgacctcttggctctctctgcactttgccccctgtctcaaaaatgtccctcatgtccatttcctgtccaggagactcatgaggactgtgtgacctgcacaagcccacacctgggcaggctgttggtgtctccttggtccttaggcagatactcccctgagtccccgatctagggccagctgcagagggctctctctaggcagagcgttcctggccagagctctacctctttgcctcctgctgacccctgacagcgtcccgtggcatttctttcatgtctgcatattgcatagccttgtcctcctgtgtgcctgagctcctcccttttcaataagattattagtcgtgcatgtctgtgagctgcctttcatcaccatttttcctgagtagggcttagttttattctggaaagacatctccaaggtgaggtccacccccacagcagacctcaagtagaaattgcccaatttttaccagctggagggacacccttgggtttttgtacgaagctatttaatgagcctgtgtcttggggactcagcaggctggagcttggggcctggtggaccatcacctggtgtctgtaggtggacccggtctcccacaggtgacatcaacctgagggtggcgtctttagagacaggcacatgggcagccctgttcccttcgcctctactgcgaggcctggggagatgttgttttcatgctgcttccaccatcacactggggtttctggatgggaaataaaaaaataaaggcagttcatttcccca

SEQ ID NO: 6439 - DNA, 3147 bp, Homo sapiens
cacacgcacacacacacacacaaacacacgcgcacgcaaacagcagtgaggaagagaaaagcagagataagcaaggctccgcagcagcctcctttctaacttgaccctcgccagaccctggccagcatggttgtcctgaatccaatgactttgggaatttatcttcagcttttcttcctctctatcgtgtctcagccgactttcatcaacagcgttcttccaatctcagcagcccttcccagcctggatcagaagaagcgtggtggccacaaagcatgctgcctgctgacgcctcctccaccaccactgttcccaccaccattcttcagaggtggccgaagtccgcttctctccccagacatgaagaatctcatgctggaactggagacctcgcagtccccgtgcatgcaaggctcgctaggctcccctgggcctcccggcccccagggtccaccggggcttcctggcaagacaggaccaaagggagaaaagggggagcttggccgaccaggaaggaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcagagttcaagaactccttgcacattaccaagacggcccccagtgccatgtggacaaggcagccggtcacctgtcaccgttgtggctggaaaggagtcccaagcctgcctgctccccagatttgaggaagattacatttcatcagggacagaaaggggatagtggagttatgggcccaccaggcaagcctgggccttctggtcaacctggccgtccggggcccccaggccccccacctgcaggacaacttataatgggacccaaaggggaaagaggatttcccgggcctccaggaagatgtctttgtggacccactatgaatgtgaataacccttcctacggggaatctgtgtatgggcccagttccccgcgagttcctgtgatttttgtggtcaacaaccaggaggagcttgagaggctgaacacccaaaacgccattgccttccgcagagaccagagatctctgtacttcaaggacagccttggctggctccccatccagctgacccctttctaccctgtggattacactgcagaccagcacggcacctgtggggatgggctcctgcagcctggggaggagtgtgacgacggtaacagcgatgtgggtgacgactgcatccgctgtcaccgtgcctactgtggagatggtcaccggcatgagggtgtggaggactgtgacggctctgactttggctacctgacatgcgagacctatctccctgggtcatatggagacctgcaatgcacccagtactgctacatcgactccacgccctgccgctacttcacctgagggccgtgaggagaaggtgggctgcgccccacagaactggcagcagcttctccactgtcatcaaactggccatgtcctggccccgtctccaccaacctttgtgtgacaaaaacaaggacaaattcctgctactaagacatgctgttaactcagtctgactggaagaatttaggaccactgcatcctgtcttaatccaaggtactggaaaaccttccacatgcccaacctgagacctgttccccatcgctaccatttggccaaacaaccggctacaatgctcttcctcttctggaatgttgctgacccaggccgtggacttggctgagcactgttagacacacacagacctgcaggctgttttagaatgttttgatctctttggggaatctggagtacaggcctctccgcccctgaccaccgaaacgtgcaggcattctcactcacactgggcagcccgctgtcgggtctctctaggcctatgaaccacaaagcagggaagtgggcacgttctctcggggtggctcacagctttgaacctgccaaaggacccctcgactggccacagcccagcccagcctgacgtggatgtggctgcccaggaaaagacttaactgtgaaaaagtactgagaacccacctgacccaggcttgccccaagcagaggctagagaagaggctcctcttctcagtgtttcccaaaggggcggctcttgtggtttcaaaatctctggcaccatcttgacctcttggctctctctgcactttgccccctgtctcaaaaatgtccctcatgtccatttcctgtccaggagactcatgaggactgtgtgacctgcacaagcccacacctgggcaggctgttggtgtctccttggtccttaggcagatactcccctgagtccccgatctagggccagctgcagagggctctctctaggcagagcgttcctggccagagctctacctctttgcctcctgctgacccctgacagcgtcccgtggcatttctttcatgtctgcatattgcatagccttgtcctcctgtgtgcctgagctcctcccttttcaataagattattagtcgtgcatgtctgtgagctgcctttcatcaccatttttcctgagtagggcttagttttattctggaaagacatctccaaggtgaggtccacccccacagcagacctcaagtagaaattgcccaatttttaccagctggagggacacccttgggtttttgtacgaagctatttaatgagcctgtgtcttggggactcagcaggctggagcttggggcctggtggaccatcacctggtgtctgtaggtggacccggtctcccacaggtgacatcaacctgagggtggcgtctttagagacaggcacatgggcagccctgttcccttcgcctctactgcgaggcctggggagatgttgttttcatgctgcttccaccatcacactggggtttctggatgggaaataaaaaaataaaggcagttcatttcccca

SEQ ID NO: 6440 - DNA, 1482 bp, Homo sapiens
acacacaaacacacgcgcacgcaaacagcagtgaggaagagaaaagcagagataagcaaggctccgcagcagcctcctttctaacttgaccctcgccagaccctggccagcatggttgtcctgaatccaatgactttgggaatttatcttcagcttttcttcctctctatcgtgtctcagccgactttcatcaacagcgttcttccaatctcagcagcccttcccagcctggatcagaagaagcgtggtggccacaaagcatgctgcctgctgacgcctcctccaccaccactgttcccaccaccattcttcagaggtggccgaagtccgggtccaccggggcttcctggcaagacaggaccaaagggagaaaagggggagcttggccgaccaggaaggaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcagggacagaaaggggatagtggagttatgggcccaccaggcaagcctgggccttctggtcaacctggccgtccggggcccccaggccccccacctgcaggacaacttataatgggacccaaaggggaaagaggatttcccgggcctccaggaagatgtctttgtggacccactatgaatgtgaataacccttcctacggggaatctgtgtatgggcccagttccccgcgagttcctgtgatttttgtggtcaacaaccaggaggagcttgagaggctgaacacccaaaacgccattgccttccgcagagaccagagatctctgtacttcaaggacagccttggctggctccccatccagctgacccctttctaccctgtggattacactgcagaccagcacggcacctgtggggatgggctcctgcagcctggggaggagtgtgacgacggtaacagcgatgtgggtgacgactgcatccgctgtcaccgtgcctactgtggagatggtcaccggcatgagggtgtggaggactgtgacggctctgactttggctacctgacatgcgagacctatctccctgggtcatatggagacctgcaatgcacccagtactgctacatcgactccacgccctgccgctacttcacctgagggccgtgaggagaaggtgggctgcgccccacagaactggcagcagcttctccactgtcatcaaactggccatgtcctggccccgtctccaccaacctttgtgtg

SEQ ID NO: 6441 - DNA, 2978 bp, Homo sapiens
cacacgcacacacacacacacaaacacacgcgcacgcaaacagcagtgaggaagagaaaagcagagataagcaaggctccgcagcagcctcctttctaacttgaccctcgccagaccctggccagcatggttgtcctgaatccaatgactttgggaatttatcttcagcttttcttcctctctatcgtgtctcagccgactttcatcaacagcgttcttccaatctcagcagcccttcccagcctggatcagaagaagcgtggtggccacaaagcatgctgcctgctgacgcctcctccaccaccactgttcccaccaccattcttcagaggtggccgaagtccgcttctctccccagacatgaagaatctcatgctggaactggagacctcgcagtccccgtgcatgcaaggctcgctaggctcccctgggcctcccggcccccagggtccaccggggcttcctggcaagacaggaccaaagggagaaaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcagggacagaaaggggatagtggagttatgggcccaccaggcaagcctgggccttctggtcaacctggccgtccggggcccccaggccccccacctgcaggacaacttataatgggacccaaaggggaaagaggatttcccgggcctccaggaagatgtctttgtggacccactatgaatgtgaataacccttcctacggggaatctgtgtatgggcccagttccccgcgagttcctgtgatttttgtggtcaacaaccaggaggagcttgagaggctgaacacccaaaacgccattgccttccgcagagaccagagatctctgtacttcaaggacagccttggctggctccccatccagctgacccctttctaccctgtggattacactgcagaccagcacggcacctgtggggatgggctcctgcagcctggggaggagtgtgacgacggtaacagcgatgtgggtgacgactgcatccgctgtcaccgtgcctactgtggagatggtcaccggcatgagggtgtggaggactgtgacggctctgactttggctacctgacatgcgagacctatctccctgggtcatatggagacctgcaatgcacccagtactgctacatcgactccacgccctgccgctacttcacctgagggccgtgaggagaaggtgggctgcgccccacagaactggcagcagcttctccactgtcatcaaactggccatgtcctggccccgtctccaccaacctttgtgtgacaaaaacaaggacaaattcctgctactaagacatgctgttaactcagtctgactggaagaatttaggaccactgcatcctgtcttaatccaaggtactggaaaaccttccacatgcccaacctgagacctgttccccatcgctaccatttggccaaacaaccggctacaatgctcttcctcttctggaatgttgctgacccaggccgtggacttggctgagcactgttagacacacacagacctgcaggctgttttagaatgttttgatctctttggggaatctggagtacaggcctctccgcccctgaccaccgaaacgtgcaggcattctcactcacactgggcagcccgctgtcgggtctctctaggcctatgaaccacaaagcagggaagtgggcacgttctctcggggtggctcacagctttgaacctgccaaaggacccctcgactggccacagcccagcccagcctgacgtggatgtggctgcccaggaaaagacttaactgtgaaaaagtactgagaacccacctgacccaggcttgccccaagcagaggctagagaagaggctcctcttctcagtgtttcccaaaggggcggctcttgtggtttcaaaatctctggcaccatcttgacctcttggctctctctgcactttgccccctgtctcaaaaatgtccctcatgtccatttcctgtccaggagactcatgaggactgtgtgacctgcacaagcccacacctgggcaggctgttggtgtctccttggtccttaggcagatactcccctgagtccccgatctagggccagctgcagagggctctctctaggcagagcgttcctggccagagctctacctctttgcctcctgctgacccctgacagcgtcccgtggcatttctttcatgtctgcatattgcatagccttgtcctcctgtgtgcctgagctcctcccttttcaataagattattagtcgtgcatgtctgtgagctgcctttcatcaccatttttcctgagtagggcttagttttattctggaaagacatctccaaggtgaggtccacccccacagcagacctcaagtagaaattgcccaatttttaccagctggagggacacccttgggtttttgtacgaagctatttaatgagcctgtgtcttggggactcagcaggctggagcttggggcctggtggaccatcacctggtgtctgtaggtggacccggtctcccacaggtgacatcaacctgagggtggcgtctttagagacaggcacatgggcagccctgttcccttcgcctctactgcgaggcctggggagatgttgttttcatgctgcttccaccatcacactggggtttctggatgggaaataaaaaaataaaggcagttcatttcccca
